(12) United States Patent
Reed et al.

(10) Patent No.: US 11,959,105 B2
(45) Date of Patent: Apr. 16, 2024

(54) POLYMERIZING ENZYMES FOR SEQUENCING REACTIONS

(71) Applicant: Quantum-Si Incorporated, Guilford, CT (US)

(72) Inventors: Brian Reed, Madison, CT (US); Manjula Pandey, Guilford, CT (US)

(73) Assignee: Quantum-Si Incorporated, Branford, CT (US)

( * ) Notice: Subject to any disclaimer, the term of this patent is extended or adjusted under 35 U.S.C. 154(b) by 362 days.

(21) Appl. No.: 16/914,195

(22) Filed: Jun. 26, 2020

(65) Prior Publication Data

US 2021/0102180 A1    Apr. 8, 2021
US 2021/0395707 A9    Dec. 23, 2021

Related U.S. Application Data

(60) Provisional application No. 62/993,597, filed on Mar. 23, 2020, provisional application No. 62/868,806, filed on Jun. 28, 2019.

(51) Int. Cl.
| | |
|---|---|
| *C12N 9/12* | (2006.01) |
| *C12N 1/21* | (2006.01) |
| *C12N 11/00* | (2006.01) |
| *C12P 19/34* | (2006.01) |
| *C12Q 1/6806* | (2018.01) |

(52) U.S. Cl.
CPC ............ *C12N 9/1247* (2013.01); *C12N 11/00* (2013.01); *C12P 19/34* (2013.01); *C12Q 1/6806* (2013.01); *C12Y 207/07006* (2013.01); *C07K 2319/21* (2013.01)

(58) Field of Classification Search
None
See application file for complete search history.

(56) References Cited

U.S. PATENT DOCUMENTS

| | | | |
|---|---|---|---|
| 5,707,804 A | 1/1998 | Mathies et al. | |
| 5,851,840 A | 12/1998 | Sluka et al. | |
| 6,153,442 A | 11/2000 | Pirio et al. | |
| 6,248,518 B1 | 6/2001 | Parkhurst et al. | |
| 6,255,083 B1 | 7/2001 | Williams | |
| 6,762,048 B2 | 7/2004 | Williams | |
| 6,787,308 B2 | 9/2004 | Balasubramanian et al. | |
| 6,846,638 B2 | 1/2005 | Shipwash | |
| 6,869,764 B2 | 3/2005 | Williams et al. | |
| 6,936,702 B2 | 8/2005 | Williams et al. | |
| 7,052,847 B2 | 5/2006 | Korlach et al. | |
| 7,056,661 B2 | 6/2006 | Korlach et al. | |
| 7,229,799 B2 | 6/2007 | Williams | |
| 7,361,466 B2 | 4/2008 | Korlach et al. | |
| 7,968,702 B2 | 6/2011 | Wegener et al. | |
| 8,034,623 B2 | 10/2011 | Oh et al. | |
| 8,084,734 B2 | 12/2011 | Vertes et al. | |
| 8,153,375 B2 | 4/2012 | Travers et al. | |
| 8,192,961 B2 | 6/2012 | Williams | |
| 8,252,910 B2 | 8/2012 | Korlach et al. | |
| 8,257,954 B2 | 9/2012 | Clark et al. | |
| 8,309,330 B2 | 11/2012 | Travers et al. | |
| 8,354,252 B2 | 1/2013 | Wegener et al. | |
| 8,404,808 B2 | 3/2013 | Salas Falgueras et al. | |
| 8,420,366 B2 | 4/2013 | Clark et al. | |
| 8,455,193 B2 | 6/2013 | Travers et al. | |
| 8,530,154 B2 | 9/2013 | Williams | |
| 8,581,179 B2 | 11/2013 | Franzen | |
| 8,846,881 B2 | 9/2014 | Korlach et al. | |
| 8,906,614 B2 | 12/2014 | Wegener et al. | |
| 8,927,212 B2 | 1/2015 | Kong et al. | |
| 8,980,584 B2 | 3/2015 | Williams | |
| 9,062,091 B2 | 6/2015 | Bjornson et al. | |
| 9,404,146 B2 | 8/2016 | Travers et al. | |
| 9,435,810 B2 | 9/2016 | Havranek et al. | |
| 9,464,107 B2 | 10/2016 | Wegener et al. | |
| 9,542,527 B2 | 1/2017 | Travers et al. | |
| 9,551,031 B2 | 1/2017 | Korlach et al. | |
| 9,551,660 B2 | 1/2017 | Kong et al. | |
| 9,566,335 B1 | 2/2017 | Emili et al. | |
| 9,582,640 B2 | 2/2017 | Travers et al. | |
| 9,600,626 B2 | 3/2017 | Travers et al. | |
| 9,678,080 B2 | 6/2017 | Bjornson et al. | |
| 9,719,073 B2 | 8/2017 | Emig et al. | |
| 9,845,501 B2 | 12/2017 | Williams | |
| 9,879,319 B2 | 1/2018 | Korlach et al. | |

(Continued)

FOREIGN PATENT DOCUMENTS

| | | |
|---|---|---|
| CN | 101365807 A | 2/2009 |
| CN | 102648275 A | 8/2012 |

(Continued)

OTHER PUBLICATIONS

Gasteiger et al., Protein Identification and Analysis Tools on the ExPASy Server, The Proteomics Protocols Handbook, 2005. (Year: 2005).*
Uniprot, Accession No. A0A8D6UFH5, 2022, www.uniprot.org. (Year: 2022).*
Invitation to Pay Additional Fees for Application No. PCT/US2017/067427 dated Apr. 26, 2018.
International Search Report and Written Opinion for Application No. PCT/US2017/067427 dated Jun. 25, 2018.
International Preliminary Report on Patentability for Application No. PCT/US2017/067427 dated Jul. 4, 2019.
International Search Report and Written Opinion for Application No. PCT/US2020/039994 dated Oct. 6, 2020.

(Continued)

*Primary Examiner* — Todd M Epstein
(74) *Attorney, Agent, or Firm* — Wolf, Greenfield & Sacks, P.C.

(57) ABSTRACT

Compositions comprising modified recombinant polymerizing enzymes are provided, along with nucleic acid molecules encoding the modified polymerizing enzymes. In some aspects, methods of using such polymerizing enzymes to synthesize a nucleic acid molecule or to sequence a nucleic acid template are provided.

17 Claims, 38 Drawing Sheets

Specification includes a Sequence Listing.

(56) References Cited

U.S. PATENT DOCUMENTS

| | | | |
|---|---|---|---|
| 9,910,956 B2 | 3/2018 | Travers et al. | |
| 9,957,291 B2 | 5/2018 | Sebo et al. | |
| 10,023,605 B2 | 7/2018 | Bjornson et al. | |
| 10,066,258 B2 | 9/2018 | Kong et al. | |
| 10,150,872 B2 | 12/2018 | Zheng et al. | |
| 10,161,002 B2 | 12/2018 | Korlach et al. | |
| 10,481,162 B2 | 11/2019 | Emili et al. | |
| 10,544,449 B2 | 1/2020 | Shen et al. | |
| 10,545,153 B2 | 1/2020 | Marcotte et al. | |
| 10,570,445 B2 | 2/2020 | Kong et al. | |
| 10,676,788 B2 | 6/2020 | Shen et al. | |
| 10,745,750 B2 | 8/2020 | Korlach et al. | |
| 10,787,573 B2 | 9/2020 | Zheng et al. | |
| 11,312,944 B2 * | 4/2022 | Reed | C12P 19/34 |
| 2005/0042633 A1 | 2/2005 | Williams | |
| 2005/0266456 A1 | 12/2005 | Williams et al. | |
| 2007/0072196 A1 | 3/2007 | Xu et al. | |
| 2007/0219367 A1 | 9/2007 | Shchepinov et al. | |
| 2009/0263802 A1 | 10/2009 | Drmanac | |
| 2010/0009872 A1 | 1/2010 | Eid et al. | |
| 2010/0029494 A1 | 2/2010 | Cherkasov et al. | |
| 2010/0035254 A1 | 2/2010 | Williams | |
| 2010/0255487 A1 * | 10/2010 | Beechem | C12N 9/1241 |
| | | | 435/6.12 |
| 2011/0003343 A1 | 1/2011 | Nikiforov et al. | |
| 2011/0281776 A1 | 11/2011 | Eshoo et al. | |
| 2012/0034602 A1 | 2/2012 | Emig et al. | |
| 2012/0115188 A1 | 5/2012 | Faurholm et al. | |
| 2012/0322692 A1 | 12/2012 | Pham et al. | |
| 2013/0217007 A1 | 8/2013 | Kamtekar et al. | |
| 2013/0316912 A1 | 11/2013 | Bjornson et al. | |
| 2017/0136433 A1 | 5/2017 | Sun et al. | |
| 2018/0208911 A1 * | 7/2018 | Reed | C12P 19/34 |
| 2018/0211003 A1 | 7/2018 | Travers et al. | |
| 2018/0299460 A1 | 10/2018 | Emili | |
| 2018/0346507 A1 | 12/2018 | Sebo et al. | |
| 2019/0010183 A1 | 1/2019 | Bjornson et al. | |
| 2019/0249153 A1 | 8/2019 | Kamtekar et al. | |
| 2020/0141944 A1 | 5/2020 | Emili et al. | |
| 2020/0148727 A1 | 5/2020 | Tullman et al. | |
| 2023/0058852 A1 | 2/2023 | Reed et al. | |

FOREIGN PATENT DOCUMENTS

| | | |
|---|---|---|
| DE | 19810879 A1 | 9/1999 |
| JP | 2002-506637 A | 3/2002 |
| JP | 2012-507986 A | 4/2012 |
| WO | WO 2005/044836 A2 | 5/2005 |
| WO | WO 2007/070572 A2 | 6/2007 |
| WO | WO 2010/062776 A2 | 6/2010 |
| WO | WO 2010/065322 A1 | 6/2010 |
| WO | WO 2010/115016 A2 | 10/2010 |
| WO | WO 2011/040971 A2 | 4/2011 |
| WO | WO 2011/040971 A9 | 4/2011 |
| WO | WO 2016/055778 A1 | 4/2016 |
| WO | WO 2018/118997 A2 | 6/2018 |
| WO | WO 2019/040825 A1 | 2/2019 |

OTHER PUBLICATIONS

International Preliminary Report on Patentability for Application No. PCT/US2020/039994 dated Jan. 6, 2022.

[No Author Listed] Genbank Accession No. KWY14141.1, published Feb. 2, 2016. 2 pages.

Koushik et al., Cerulean, Venus, and VenusY67C FRET reference standards. Biophys J. Dec. 15, 2006;91(12):L99-L101. doi: 10.1529/biophysj.106.096206. Epub Oct. 13, 2006. PMID: 17040988; PMCID: PMC1779932.

Perez-Arnaiz et al., Involvement of phage phi29 DNA polymerase and terminal protein subdomains in conferring specificity during initiation of protein-primed DNA replication. Nucleic Acids Res. 2007;35(21):7061-73. doi: 10.1093/nar/gkm749. Epub Oct. 2, 2007.

Rodriguez et al., A specific subdomain in phi29 DNA polymerase confers both processivity and strand-displacement capacity. Proc Natl Acad Sci U S A. May 3, 2005;102(18):6407-12. doi: 10.1073/pnas.0500597102. Epub Apr. 21, 2005.

Saito et al., Dual-labeled oligonucleotide probe for sensing adenosine via FRET: a novel alternative to SNPs genotyping. Chem Commun (Camb). Jun. 7, 2007;(21):2133-5. doi: 10.1039/b618465k. Epub Feb. 28, 2007. PMID: 17520113.

Sato et al., Polyproline-rod approach to isolating protein targets of bioactive small molecules: isolation of a new target of indomethacin. J Am Chem Soc. Jan. 31, 2007;129(4):873-80. doi: 10.1021/ja0655643. PMID: 17243824.

Stryer et al., Energy transfer: a spectroscopic ruler. Proc Natl Acad Sci U S A. Aug. 1967;58(2):719-26. doi: 10.1073/pnas.58.2.719. PMID: 5233469; PMCID: PMC335693.

Williams et al., An artificial processivity clamp made with streptavidin facilitates oriented attachment of polymerase-DNA complexes to surfaces. Nucleic Acids Res. Oct. 2008;36(18):e121. doi: 10.1093/nar/gkn531. Epub Aug. 22, 2008. PMID: 18723573; PMCID: PMC2566871.

U.S. Appl. No. 17/690,920, filed Mar. 9, 2022, Reed et al.

* cited by examiner

FIG. 5B

EFM37 nanoball assay with 10uM dN6Ps

|  | EFM89 batch 1 | EFM89 batch 2 |
|---|---|---|
| Insert length | 2kb | 2kb |
| Total Reads | 1202 | 766 |
| Rate (nt/sec) | 0.87 | 0.89 |
| Pulse width (s) | 0.16 | 0.19 |
| Interpulse duration (s) | 0.56 | 0.52 |
| Accuracy | 76% | 74% |
| Read length (bases) | 3043 | 3263 |

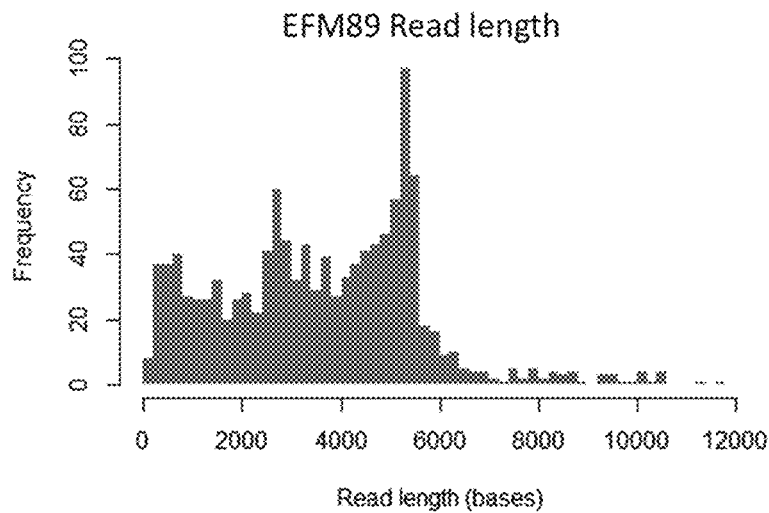
FIG. 12C
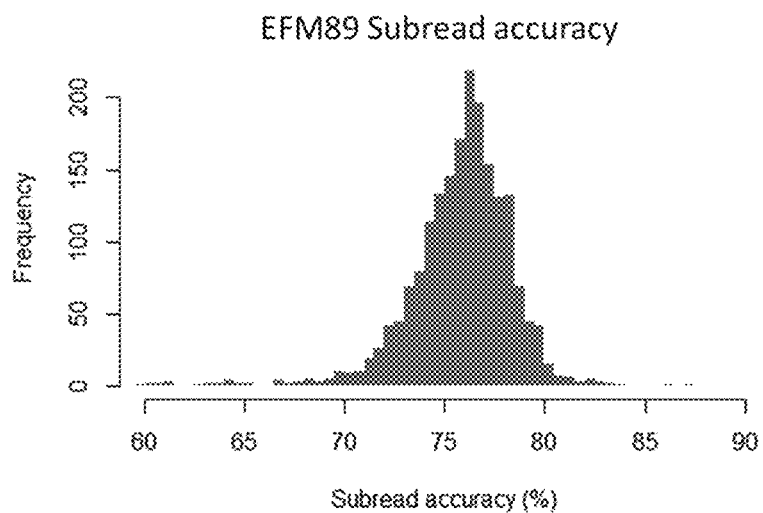
FIG. 12D
```
1: WP_060797276.1   100.00   94.94   94.59   95.11
2: WP_107600270.1    94.94  100.00   99.65   99.83
3: WP_107537579.1    94.59   99.65  100.00   99.48
4: WP_079232085.1    95.11   99.83   99.48  100.00
```
FIG. 13A

| SEQ ID NO: | | |
|---|---|---|
| 2 | WP_060797276.1 | -MIKKYTGDFETTTDLHDCRVKSKGVCDIDNVDNITFGLEIDSFFEKCEMQGSTDIYFHN |
| 3 | WP_107600270.1 | MMIKKYTGDFETTTDLHDCRVKSKGVCDIDNVDNITFGLDIDSFFEKCEMQGSTDIYFHN |
| 4 | WP_107537579.1 | MMIKKYTGDFETTTDLHDCRVKSKGVCDIDNVDNITFGLDIDSFFEKCEMQGSTDIYFHN |
| 5 | WP_079232085.1 | -MIKKYTGDFETTTDLHDCRVKSKGVCDIDNVDNITFGLDIDSFFEKCEMQGSTDIYFHN |

WP_060797276.1  EKFDGEFMLSNLFKNGFKMCKEAKEERTFSTLISNMGQMYALEICNNVKCTTTKTGKTKK
WP_107600270.1  EKFDGEFMLSNLFKNGFKMSKETKEERTFSTLISNMGQMYALEICNEVNYATTKSGKTKK
WP_107537579.1  EKFDGEFMLSNLFKNGFKMSKETKEERTFSTLISNMGQMYALEICNEVNYATTKSGKTKK
WP_079232085.1  EKFDGEFMLSNLFKNGFKMSKETKEERTFSTLISNMGQMYALEICNEVNYTTTKSGKTKK

WP_060797276.1  EKQRTIIYDSLKKYPFPVKEIAEAFNFPIKKGEIDYTKERPIGYNPTDDENDYLKNDIQI
WP_107600270.1  EKVRTIIYDSLKKYPFPVKQIAEAFNFPIKKGEIDYTKERPVGYNPTDDENDYLKNDIQI
WP_107537579.1  EKVRTIIYDSLKKYPFPVKQIAEAFNFPIKKGEIDYTKERPVGYNPTDDENEYLKNDIQI
WP_079232085.1  EKVRTIIYDSLKKYPFPVKQIAEAFNFPIKKGEIDYTKERPVGYNPTDDENDYLKNDIQI

WP_060797276.1  MAMALKIQFDQGLTRNTRGSDALGDYQDNVKTTYGKSRFKQMFPVLSLGFDKDLRKAYKG
WP_107600270.1  MAMALKIQFDQGLTRNTRGSDALGDYKDNLKATHGKSTFKQMFPILSLGFDKDLRKAYKG
WP_107537579.1  MAMALKIQFDQGLTRNTRGSDALGDYKDNLKATHGKSTFKQMFPILSLGFDKDLRKAYKG
WP_079232085.1  MAMALKIQFDQGLTRNTRGSDALGDYKDNLKATHGKSTFKQMFPILSLGFDKDLRKAYKG

WP_060797276.1  GFTNVNKVFQGKEIGEGIVFDVNSLYPSQMYVRPLPYGTPLFYEGEYKENIDYPLYIQNI
WP_107600270.1  GFTNVNKVFQGKEIGDGIVFDVNSLYPSQMYVRPLPYGTPLFYEGEYKPNMDYPLYIQNI
WP_107537579.1  GFTNVNKVFQGKEIGDGIVFDVNSLYPSQMYVRPLPYGTPLFYEGEYKPNMDYPLYIQNI
WP_079232085.1  GFTNVNKVFQGKEIGDGIVFDVNSLYPSQMYVRPLPYGTPLFYEGEYKPNMDYPLYIQNI

WP_060797276.1  KVRFRLKERHIPTIQVKQSSLFIQNEYLESSVNKLGVDELIDLTLTNVDLDLFFEHYDIL
WP_107600270.1  KVRFRLKEGYIPTIQVKQSSLFIQNEYLDSSVNKLGVDELIDLTLTNVDLELFFEHYDIL
WP_107537579.1  KVRFRLKEGYIPTIQVKQSSLFIQNEYLDSSVNKLGVDELIDLTLTNVDLELFFEHYDIL
WP_079232085.1  KVRFRLKEGYIPTIQVKQSSLFIQNEYLDSSVNKLGVDELIDLTLTNVDLELFFEHYDIL

WP_060797276.1  EIHYTGYNFKASCDMFKGNEDKNIEVKNTTEGARKANAKGNLNSLYGKFGTNPDITGKV
WP_107600270.1  EIHYTGYNFKASCDMFKGNEDKNIEVKNTTEGARKANAKGNLNSLYGKFGTNPDITGKV
WP_107537579.1  EIHYTGYNFKASCDMFKGNEDKNIEVKNTTEGARKANAKGNLNSLYGKFGTNPDITGKV
WP_079232085.1  EIHYTGYNFKASCDMFKGNEDKNIEVKNTTEGARKANAKGNLNSLYGKFGTNPDITGKV

WP_060797276.1  PYNGEDGIVRLTLGEEELRDPYYVPLASFVTAKGRYTTITTAQRCFDNIIYCDTDSIHLT
WP_107600270.1  PYNGEDGIVRLTLGEEELRDPYYVPLASFVTAKGRYTTITTAQRCFDRIIYCDTDSIHLV
WP_107537579.1  PYNGEDGIVRLTLGEEELRDPYYVPLASFVTAKGRYTTITTAQRCFDRIIYCDTDSIHLV
WP_079232085.1  PYNGEDGIVRLTLGEEELRDPYYVPLASFVTAKGRYTTITTAQRCFDRIIYCDTDSIHLV

WP_060797276.1  GTEVPEAIEHLVDSCKLGYNKNESTFQRAKFIRQKTYVEEIDGELNVKCAGMPDRIKELV
WP_107600270.1  GTDVPEAIEHLVDPKKLGYNGNESTFQRAKFIRQKTYVEEIDGELNVKCAGMPDRIKELV
WP_107537579.1  GTDVPEAIEHLVDPKKLGYNGNESTFQRAKFIRQKTYVEEIDGELNVKCAGMPDRIKELV
WP_079232085.1  GTDVPEAIEHLVDPKKLGYNGNESTFQRAKFIRQKTYVEEIDGELNVKCAGMPDRIKELV

WP_060797276.1  TFDNFEVGFSSYGKLLPKRTQGGVVLVDTMFTIK
WP_107600270.1  TFDNFEVGFSSYGKLLPKRTQGGVVLVDTMFTIK
WP_107537579.1  TFDNFEVGFSSYGKLLPKRTQGGVVLVDTMFTIK
WP_079232085.1  TFDNFEVGFSSYGKLLPKRTQGGVVLVDTMFTIK

FIG. 13B

| SEQ ID NO: | alignment: |
|---|---|
| 845 | WKHESTFQRAKFIRQKTYVEEIDG--------------------ELNVKCAGMPDRIKELVTF |
| 827 | WAHESTFKRAKYLRQKTYIQDI--YMKEVDGKLVEGSPDDYTDIKFSVKCAGMTDKIKKEVTF |

|  | EFM89 | EFM158 |
|---|---|---|
| Template | 2kb #14 | 2kb #22 |
| Loading | 0.9% | 15.3% |
| Read Length | 3 kb | 5.4 kb |
| Rate (nt/s) | 0.87 | 0.91 |
| Accuracy | 76% | 75% |
| Still Active at 6h | 0.9% | 12.2% |
| N50 | 4 kb | 8.6 kb |

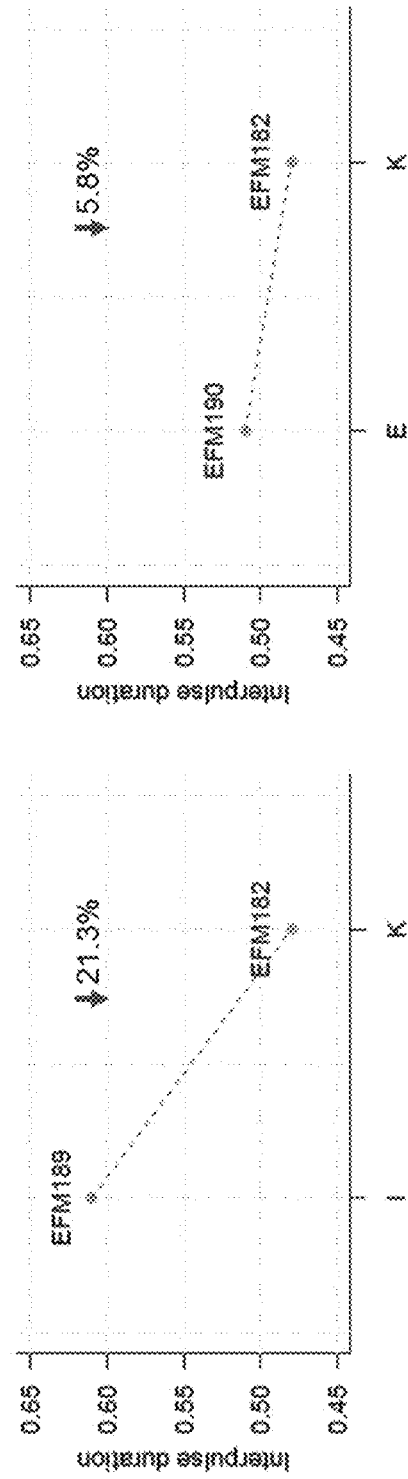
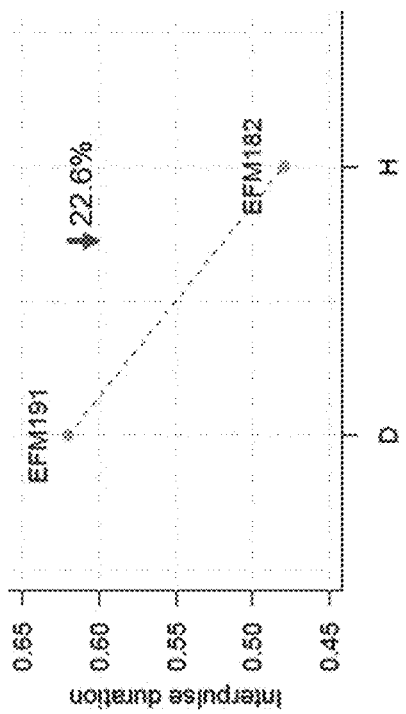
FIG. 22A
FIG. 22B
FIG. 22C

| substitution | counts before selection | counts after selection | normalized enrichment |
|---|---|---|---|
| D232H | 1 | 37 | 16.63 |
| V564L | 4 | 138 | 15.52 |
| E283K | 2 | 69 | 15.45 |
| F353C | 1 | 33 | 14.77 |
| C26W | 1 | 30 | 13.51 |
| V315L | 1 | 26 | 11.63 |
| M95T | 11 | 281 | 11.43 |
| A236G | 1 | 24 | 10.78 |
| L555R | 3 | 71 | 10.65 |
| D425N | 12 | 284 | 10.62 |
| P273R | 2 | 47 | 10.56 |
| L320T | 2 | 44 | 9.90 |
| V247D | 8 | 161 | 9.02 |
| V526L | 1 | 20 | 9.00 |
| V25L | 4 | 80 | 8.95 |
| A486E | 7 | 136 | 8.72 |
| T571S | 21 | 398 | 8.51 |
| K119Q | 2 | 36 | 8.06 |
| T114S | 7 | 124 | 7.95 |
| N33T | 6 | 104 | 7.77 |
| E436G | 9 | 155 | 7.74 |
| I153V | 10 | 172 | 7.73 |
| F36V | 4 | 68 | 7.62 |
| S503T | 2 | 33 | 7.40 |
| N175Y | 7 | 113 | 7.22 |
| T13N | 1 | 16 | 7.21 |
| G574R | 1 | 15 | 6.74 |
| F188C | 2 | 30 | 6.74 |
| M569K | 10 | 144 | 6.47 |
| S216G | 14 | 201 | 6.45 |
| S42T | 1 | 14 | 6.29 |
| P160A | 2 | 28 | 6.27 |
| R217G | 1 | 14 | 6.27 |
| G547S | 15 | 207 | 6.20 |
| E152D | 12 | 164 | 6.14 |
| S216R | 8 | 107 | 6.01 |
| Q323R | 19 | 254 | 6.00 |
| G228A | 4 | 53 | 5.95 |
| M49K | 7 | 92 | 5.91 |
| A100V | 19 | 245 | 5.79 |
| K557R | 8 | 101 | 5.66 |
| M49V | 12 | 149 | 5.59 |
| E142K | 5 | 61 | 5.47 |
| D17N | 12 | 146 | 5.45 |

FIG. 25

POLYMERIZING ENZYMES FOR SEQUENCING REACTIONS

RELATED APPLICATIONS

This application claims priority under 35 U.S.S. § 119(e) to U.S. provisional patent application No. 62/868,806, filed Jun. 28, 2019, and to U.S. provisional patent application No. 62/993,597, filed Mar. 23, 2020, each of which is hereby incorporated by reference in its entirety.

REFERENCE TO A SEQUENCE LISTING SUBMITTED AS A TEXT FILE VIA EFS-WEB

The instant application contains a Sequence Listing which has been submitted in ASCII format via EFS-Web and is hereby incorporated by reference in its entirety. Said ASCII copy, created on Oct. 15, 2020, is named P109070042US00-SEQ-GIC and is 4,085 kilobytes in size.

BACKGROUND

DNA polymerases are nucleotide polymerizing enzymes that are essential for the replication of the genomes of all living organisms. In addition to their role in maintaining genome integrity during replication and repair, DNA polymerases are widely used for DNA manipulation in vitro, including DNA cloning, mutagenesis, and sequencing. The fundamental ability of DNA polymerases to synthesize a complementary strand according to a template DNA is conserved, although specific properties, including processivity, fidelity, and substrate nucleotide selectivity, differ among the enzymes.

SUMMARY

Aspects of the technology disclosed herein relate to modified polymerizing enzymes (e.g., polymerases) that may be used to conduct in vitro polymerization reactions. In some aspects, polymerases described herein are suitable for use in sequencing reactions (e.g., nucleic acid sequencing). In some aspects, the disclosure provides recombinant polymerases having one or more modifications. In some embodiments, recombinant polymerases of the disclosure comprise at least one of an amino acid mutation or a domain substitution.

In some aspects, the disclosure provides a modified polymerizing enzyme (e.g., a nucleic acid polymerizing enzyme, or a nucleic acid polymerase) having an amino acid sequence that is based on a naturally occurring polymerase (e.g., selected from TABLE 1) and that includes one or more amino acid mutations and/or segment substitutions. In some embodiments, a modified polymerizing enzyme has an amino acid sequence that is based on E. faecium polymerase (SEQ ID Nos: 2-5). In some embodiments, a modified polymerizing enzyme has an amino acid sequence that is based on SEQ ID Nos: 23-33. In some embodiments, a modified polymerizing enzyme comprises one or more segment substitutions (e.g., wherein one or more segments of a polymerase are replaced with one or more corresponding segments from a different polymerase), one or more amino acid additions, deletions, and/or substitutions, or a combination thereof. In some embodiments, a segment comprises a defined region of a polymerase (e.g., a structural or functional domain or subdomain), or a portion thereof, and optionally including one or more flanking amino acids (e.g., 1-50, 1-40, 1-30, 1-20, 1-10, 1-5, 5-10, 5-25, or any integral number within these ranges of amino acids on either side of a region or portion thereof, for example in a naturally-occurring polymerase of TABLE 1, e.g., SEQ ID Nos: 2-5 or SEQ ID Nos: 23-33). In some embodiments, one or more amino acid insertions, deletions, or substitutions correspond to naturally occurring differences between two naturally-occurring polymerases at one or more positions. In some embodiments, one or more amino acid insertions, deletions, or substitutions are new non-naturally occurring changes. In some embodiments, an amino acid substitution is a conservative amino acid substitution (e.g., replacing one amino acid with another amino acid having similar properties, for example having similar charged, polar, hydrophobic, hydrophilic, and/or other similar properties such as similar size). In some embodiments, an amino acid substitution is a non-conservative amino acid substitution. In some embodiments, one or more amino acid insertions, deletions, or substitutions can be at any position(s) in a modified polymerase, including in one or more swapped segments from different polymerases and/or in segments of the original polymerase.

Accordingly, in some embodiments the disclosure provides a recombinant polymerizing enzyme having an amino acid sequence selected from TABLE 1, e.g., SEQ ID Nos: 2-5 or SEQ ID Nos: 23-33 (or having an amino acid sequence that has at least 50%, at least 60%, at least 70%, at least 80%, 80-90%, 90-95%, 95-99%, or higher amino acid sequence identity to an amino acid sequence selected from TABLE 1, e.g., SEQ ID Nos: 2-5 or SEQ ID Nos: 23-33) and comprising one or more amino acid modifications from TABLE 2, TABLE 3, TABLE 4, TABLE 5, TABLE 6, or TABLE 7. In some embodiments, the one or more amino acid modifications include at least one amino acid mutation (e.g., 1, 2, 3, 4, 5, 6, 7, 8, 9, 10, 15, 20, 25, or more amino acid mutations). In some embodiments, the one or more amino acid modifications include at least 1 and up to 5 amino acid mutations, at least 1 and up to 10 amino acid mutations, at least 1 and up to 15 amino acid mutations, at least 1 and up to 25 amino acid mutations, at least 1 and up to 50 amino acid mutations, or at least 1 and up to 100 amino acid mutations. In some embodiments, the one or more amino acid modifications include at least one domain substitution (e.g., a substitution of an entire domain or a substitution of a segment that encompasses a domain or a portion of a domain). In some embodiments, the at least one domain substitution comprises at least one of an exonuclease domain substitution and a polymerase domain substitution. In some embodiments, an exonuclease domain substitution comprises an exonuclease loop substitution. In some embodiments, a polymerase domain substitution comprises any one of a palm subdomain substitution, a TPR1 subdomain substitution, a fingers subdomain substitution, a TPR2 subdomain substitution, or a thumb subdomain substitution (e.g., a substitution of an entire polymerase, palm, TPR1, fingers, TPR2, or thumb domain or subdomain, or a portion of any one thereof, optionally including one or more flanking amino acids). In some embodiments, the one or more amino acid modifications include at least one domain substitution and at least one amino acid mutation. In some embodiments, an amino acid mutation can be an amino acid insertion, deletion, or substitution.

In some embodiments, a recombinant polymerizing enzyme of the disclosure has a sequence selected from TABLE 2. In some embodiments, the disclosure provides a recombinant polymerizing enzyme having a sequence selected from TABLE 3. In some embodiments, the disclosure provides a recombinant polymerizing enzyme having a sequence selected from TABLE 4. In some embodiments, the disclosure provides a recombinant polymerizing enzyme having a combination of modification listed in TABLE 7.

In some aspects, the disclosure provides a recombinant polymerizing enzyme comprising a segment that includes an exonuclease region or a portion thereof (and optionally flanking amino acids on one or both sides) of any one of recombinant polymerizing enzymes in TABLE 1 (e.g., SEQ ID Nos: 2-5 or SEQ ID Nos: 23-33). In some aspects, the disclosure provides a recombinant polymerizing enzyme comprising a segment that includes a palm region or a portion thereof (and optionally flanking amino acids on one or both sides) of any one of recombinant polymerizing enzymes in TABLE 1 (e.g., SEQ ID Nos: 2-5 or SEQ ID Nos: 23-33). In some aspects, the disclosure provides a recombinant polymerizing enzyme comprising a segment that includes a TPR1 region or a portion thereof (and optionally flanking amino acids on one or both sides) of any one of recombinant polymerizing enzymes in TABLE 1 (e.g., SEQ ID Nos: 2-5 or SEQ ID Nos: 23-33). In some aspects, the disclosure provides a recombinant polymerizing enzyme comprising a segment that includes a fingers region or a portion thereof (and optionally flanking amino acids on one or both sides) of any one of recombinant polymerizing enzymes in TABLE 1 (e.g., SEQ ID Nos: 2-5 or SEQ ID Nos: 23-33). In some aspects, the disclosure provides a recombinant polymerizing enzyme comprising a segment that includes a TPR2 region or a portion thereof (and optionally flanking amino acids on one or both sides) of any one of recombinant polymerizing enzymes in TABLE 1 (e.g., SEQ ID Nos: 2-5 or SEQ ID Nos: 23-33). In some aspects, the disclosure provides a recombinant polymerizing enzyme comprising a segment that includes a thumb region or a portion thereof (and optionally flanking amino acids on one or both sides) of any one of recombinant polymerizing enzymes in TABLE 1 (e.g., SEQ ID Nos: 2-5 or SEQ ID Nos: 23-33). In some aspects, the disclosure provides a recombinant polymerizing enzyme comprising two or more segments as described herein.

Accordingly, in some embodiments, a recombinant polymerizing enzyme is a chimeric enzyme that comprises one or more amino acid segments from different polymerizing enzymes (e.g., from a different species). In some embodiments, a chimeric polymerase comprises an amino acid sequence from a first polymerizing enzyme in which one or more segments have been replaced with segment(s) from different polymerizing enzymes. In some embodiments, the one or more segments from different polymerizing enzymes can be a segment comprising amino acids 1-51 from the M2Y polymerase, a segment comprising amino acids 271-375 from the E. faecium polymerase, a segment comprising amino acids 72-89 from the E. faecium polymerase, and/or a segment comprising amino acids 445-449 from the E. faecium polymerase. In some embodiments, the 1-51 segment from M2Y polymerase replaces a corresponding naturally occurring polymerase segment (e.g., amino acids 1-54 of Φ29 polymerase). In some embodiments, the 271-375 segment from E. faecium polymerase replaces a corresponding naturally occurring polymerase segment (e.g., amino acids 260-359 of Φ29 polymerase). In some embodiments, the 72-89 segment from E. faecium polymerase replaces a corresponding naturally occurring polymerase segment (e.g., amino acids 75-91 of Φ29 polymerase). In some embodiments, the 445-449 segment from E. faecium polymerase replaces a corresponding naturally occurring polymerase segment (e.g., amino acids 429-433 of Φ29 polymerase).

In some embodiments, a recombinant polymerizing enzyme comprises one or more substitutions corresponding to the following substitutions in Φ29: M8R, V51A, N62D, I71V, L107I, K131E, K135Q, L142K, G197D, Y224K, E239G, V250A/I, L253A/H, Y281H, I288L, T301C, R306Q, R308L, D325E, D341E, K354R, T368F, E375Y, A437G, A444T, E466K, D476H, A484E, E508R, D510K/R, K512Y, E515Q, K539E, D570S, and T571V.

In some embodiments, a recombinant polymerizing enzyme comprises one or more substitutions corresponding to the following substitutions in E. faecium: K4R, S22A, N59D, E60L, E85P, N106G, Q122V, P136T, E139K/Q, E142K/Q, I148K, D167P, D171K, D189K, T211A, D232K, V261A/I, L264A/H/M, T479V, E482K, D492H, S493P, K500E, Q513D, E519R, D521K/R, E523K/Y, R308G, S319L, L320M, E323V, D337G, E338K, D341T, I384F/S, E391Y/W/F/H/M/K/R, L437Y, E537K, T568S, and M569V.

In some embodiments, a modified polymerase comprises one or more of the segment substitutions and/or amino acid insertions, deletions, and/or substitutions described herein, and also comprises one or more (e.g., 1-5, 5-10, 10-25, 25-50, 50-75, 75-100, 100-125, 125-150) additional amino acid insertions, deletions, and/or substitutions (e.g., conservative or non-conservative amino acid substitutions). Accordingly, in some embodiments, a modified polymerase of TABLE 2, TABLE 3, or TABLE 4 can include one or more additional (e.g., 1-5, 5-10, 10-25, 25-50, 50-75, 75-100, 100-125, 125-150) additional amino acid insertions, deletions, and/or substitutions (e.g., conservative or non-conservative amino acid substitutions).

In some aspects, the disclosure relates to modified recombinant enzymes comprising a first segment and a second segment, wherein: the first segment comprises an amino acid sequence corresponding to a first reference segment, said first reference segment containing amino acids 197-271 of SEQ ID NO: 2, wherein the amino acid sequence of the first segment is at least 80%, 80-90%, 90-95%, or at least 95% identical to the amino acid sequence of the first reference segment, and wherein the first segment has a higher isoelectric point than the first reference segment; and the second segment comprises an amino acid sequence corresponding to a second reference segment, said second reference segment containing amino acids 443-528 of SEQ ID NO: 2, wherein the amino acid sequence of the second segment is at least 80%, 80-90%, 90-95%, or at least 95% identical to the amino acid sequence of the second reference segment, and wherein the second segment has a higher isoelectric point than the second reference segment. In particular embodiments, the first segment comprises an amino acid sequence that is at least 80%, 80-90%, 90-95%, or at least 95% identical to 197-271 of SEQ ID NO: 2 and the second segment comprises an amino acid sequence that is at least 80%, 80-90%, 90-95%, or at least 95% identical to amino acids 443-528 of SEQ ID NO: 2.

In some aspects, the disclosure relates to modified recombinant enzymes comprising a first segment comprising an amino acid sequence corresponding to a reference segment, said reference segment containing amino acids 1-196 of SEQ ID NO: 2, wherein the amino acid sequence of the first segment is at least 80%, 80-90%, 90-95%, or at least 95% identical to the amino acid sequence of the reference segment; and wherein the first segment has a higher isoelectric point than the reference segment. In particular embodiments, the first segment comprises an amino acid sequence that is at least 80%, 80-90%, 90-95%, or at least 95% identical to 1-196 of SEQ ID NO: 2.

In some aspects, the disclosure relates to modified recombinant enzymes comprising a first segment and a second segment, wherein: the first segment comprises an amino acid sequence corresponding to a first reference segment, said first reference segment containing amino acids 1-271 of SEQ ID NO: 2, wherein the amino acid sequence of the first segment is at least 80%, 80-90%, 90-95%, or at least 95% identical to the amino acid sequence of the first reference segment, and wherein the first segment has a higher isoelectric point than the first reference segment; and the second segment comprises an amino acid sequence corresponding to a second reference segment, said second reference segment containing amino acids 443-528 of SEQ ID NO: 2, wherein the amino acid sequence of the second segment is at least 80%, 80-90%, 90-95%, or at least 95% identical to the amino acid sequence of the second reference segment, and wherein the second segment has a higher isoelectric point than the second reference segment. In particular embodiments, the first segment comprises an amino acid sequence that is at least 80%, 80-90%, 90-95%, or at least 95% identical to 1-271 of SEQ ID NO: 2 and the second segment comprises an amino acid sequence that is at least 80%, 80-90%, 90-95%, or at least 95% identical to amino acids 443-528 of SEQ ID NO: 2.

In some embodiments, the amino acid sequence of the modified recombinant enzyme comprises a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, V443, L445, A446, S447, V449, T450, W452, G453, Y455, F465, N467, T479, E482, A484, E485, A486, L490, D492, S493, K495, K500, S503, Q506, Q513, E519, D521, E523, and V526 of SEQ ID NO: 2. In some embodiments, a modification is an amino acid substitution selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, N145H, N145R, P147Q, P147T, I148K, I148H, I148R, E152D, I153V, P160A, D167P, D167K, D167H, D167R, D171K, D171H, D171R, N175L, N175Y, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, V443T, L445M, A446G, S447V, V449I, T450A, W452Y, G453A, Y455W, F465Y, N467R, N467K, N467H, N467S, N467T, T479V, E482K, E482H, E482R, A484E, A485D, A486E, L490M, D492H, D492K, D492R, D492A, H492S, S493P, K495R, K500E, S503A, S503T, Q506K, Q513D, D521K, D521R, D521H, E523R, E523V, E523Y, E523F, E523H, E523W, and V526L.

In some embodiments, the amino acid sequence of the modified recombinant enzyme comprises a modification at one or more positions corresponding to E139, E142, N145, I148, D167, D171, D189, N467, E482, D492, K495, D521, and E523. In some embodiments, a modification is an amino acid substitution selected from the group consisting of E139K, E139Q, E139R, E139H, E142K, E142H, E142R, E142Q, N145K, N145H, N145R, I148K, I148H, I148R, D167P, D167K, D167H, D167R, D171K, D171H, D171R, D189K, D189H, D189R, N467K, N467H, N467R, N467S, N467T, E482K, E482H, E482R, D492H, D492K, D492R, K495R, D521K, D521H, D521R, E523K, E523Y, E523H, E523R, E523F, and E523W.

In some embodiments, the amino acid sequence of the modified recombinant enzyme comprises a modification at one or more positions corresponding to P273, P275, R308, V315, Q317, S319, L320, I322, Q323, D337, E338, D341, T345, F352, F353, T364, D374, I384, E385, N388, E391, A396, N397, G400, D414, D425, R429, E436, L437, D533, R534, E537, G547, E545, L555, P556, R558, T559, V564, T568, M569, and T571 of SEQ ID NO: 2. In some embodiments, a modification is an amino acid substitution selected from the group consisting of P273S, P273R, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, D374Q, D374H, I384T, I384F, I384S, E385Y, E385K, E385R, E385N, E385Q, E385L, E385A, N388T, E391Y, E391W, E391F, E391H, E391M, E391K, E391R, A396Q, N397L, G400L, D414V, D425N, R429E, E436R, E436G, L437Y, L437E, D533A, D533Q, D533T, D533R, D533S, R534K, E537K, E537H, E537R, E545K, E545H, E545R, G547S, L555K, L555R, P556A, R558H, T559V, V564L, T568D, T568S, M569K, M569T, M569V, and T571S. In some embodiments, a modification is an amino acid substitution selected from the group consisting of D374G, D374Q, D374H, E385Y, E385K, E385R, E385N, E385Q, E385L, E385A, E391Y, E391W, E391K, E391F, D533A, D533Q, D533T, D533R, D533S, E537K, E537H, E537R, E545K, E545H, and E545R.

In some embodiments, the modified recombinant enzyme comprises a combination of modifications listed in Table 7.

In some embodiments, the amino acid sequence of the modified recombinant enzyme comprises a modification at positions corresponding to E142, I148, D189, V261, L264, R308, E391, E482, D492, K500, D521, E523, and E537. In some embodiments, the modification at position E142 is E142K; the modification at position I148 is I148K; the modification at position D189 is D189K; the modification at position V261 is V261A; the modification at position L264 is L264H; the modification at position R308 is R308G; the modification at position E391 is E391Y; the modification at position E482 is E482K; the modification at position D492 is D492H; the modification at position K500 is K500E; the modification at position D521 is D521K; the modification at position E523 is E523K; and the modification at position E537 is E537K. In some embodiments, the modified recombinant enzyme comprises the amino acid sequence of SEQ ID NO: 88.

In some embodiments, the amino acid sequence of the modified recombinant enzyme comprises a modification at position E60. In some embodiments, the modification at E60 is E60L. In some embodiments, the modified recombinant enzyme comprises the amino acid sequence of SEQ ID NO: 157.

In some embodiments, the modified recombinant enzyme further comprises a bis-biotin tag.

In some embodiments, the modified recombinant enzyme comprises the amino acid sequence of SEQ ID NO: 180.

In some aspects, the disclosure relates to modified recombinant enzymes comprising one or more segments selected from: a first segment having an amino acid sequence that is at least 80%, 80-90%, 90-95%, or at least 95% identical to amino acids 1-196 of SEQ ID NO: 2, wherein the amino acid sequence of the first segment comprises a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, and D189 of SEQ ID NO: 2; a second segment having an amino acid sequence that is at least 80%, 80-90%, 90-95%, or at least 95% identical to amino acids 197-271 of SEQ ID NO: 2, wherein the amino acid sequence of the second segment comprises a modification at one or more positions corresponding to Q206, T211, S216, R217, D232, A236, V247, I253, V261, L264, and 5267 of SEQ ID NO: 2; and/or a third segment having an amino acid sequence that is at least 80%, 80-90%, 90-95%, or at least 95% identical to amino acids 443-528 of SEQ ID NO: 2, wherein the amino acid sequence of the third segment comprises a modification at one or more positions corresponding to V443, L445, A446, S447, V449, T450, W452, G453, Y455, F465, N467, T479, E482, A484, E485, A486, L490, D492, S493, K495, K500, S503, Q506, Q513, E519, D521, E523, and V526 of SEQ ID NO: 2.

In some embodiments, the modified recombinant enzyme comprises the first segment and the second segment. In some embodiments, the modified recombinant enzyme comprises the second segment and the third segment. In some embodiments, the modified recombinant enzyme comprises the first segment and the third segment. In some embodiments, the modified recombinant enzyme comprises the first segment, the second segment and the third segment.

In some embodiments, a modification is an amino acid substitution selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, N145H, N145R, P147Q, P147T, 1148K, I148H, I148R, E152D, I153V, P160A, D167P, D167K, D167H, D167R, D171K, D171H, D171R, N175T, N175Y, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S502A, S503T, Q506K, Q513D, D521K, D521R, D521H, E523R, E523V, E523Y, E523F, E523H, E523W, and V526L.

In some embodiments, the amino acid sequence of the modified recombinant enzyme comprises a modification at one or more positions corresponding to E139, E142, N145, I148, D167, D171, D189, N467, E482, D492, K495, D521, and E523. In some embodiments, a modification is an amino acid substitution selected from the group consisting of E139K, E139Q, E139R, E139H, E142K, E142H, E142R, E142Q, N145K, N145H, N145R, 1148K, I148H, I148R, D167P, D167K, D167H, D167R, D171K, D171H, D171R, D189K, D189H, D189R, N467R, N467K, N467H, N467S, N467T, E482K, E482H, E482R, D492H, D492K, D492R, K495R, D521K, D521H, D521R, E523K, E523Y, E523H, E523R, E523F, and E523W.

In some embodiments, the amino acid sequence of the modified recombinant enzyme comprises a modification at one or more positions corresponding to P273, P275, R308, V315, Q317, S319, L320, I322, Q323, D337, E338, D341, T345, F352, F353, T364, D374, I384, E385, N388, E391, A396, N397, G400, D414, D425, R429, E436, L437, D533, R534, E537, G547, E545, L555, P556, R558, T559, V564, T568, M569, and T571 of SEQ ID NO: 2. In some embodiments, a modification is an amino acid substitution selected from the group consisting of P273S, P273R, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, D374Q, D374H, I384T, I384F, I384S, E385Y, E385K, E385R, E385N, E385Q, E385L, E385A, N388T, E391Y, E391W, E391F, E391H, E391M, E391K, E391R, A396Q, N397L, G400L, D414V, D425N, R429G, E436R, E436G, L437Y, L437E, D533A, D533Q, D533T, D533R, D533S, R534K, E537K, E537H, E537R, E545K, E545H, E545R, G547S, L555K, L555R, P556A, R558H, T559V, V564L, T568D, T568S, M569K, M569T, M569V, and T571S. In some embodiments, a modification is an amino acid substitution selected from the group consisting of D374G, D374Q, D374H, E385Y, E385K, E385R, E385N, E385Q, E385L, E385A, E391Y, E391W, E391K, E391F, D533A, D533Q, D533T, D533R, D533S, E537K, E537H, E537R, E545K, E545H, and E545R.

In some embodiments, the modified recombinant enzyme comprises a combination of modifications listed in Table 7.

In some embodiments, the amino acid sequence of the modified recombinant enzyme comprises a modification at positions corresponding to E142, 1148, D189, V261, L264, R308, E391, E482, D492, K500, D521, E523, and E537. In some embodiments, the modification at position E142 is E142K; the modification at position 1148 is I148K; the modification at position D189 is D189K; the modification at position V261 is V261A; the modification at position L264 is L264H; the modification at position R308 is R308G; the modification at position E391 is E391Y; the modification at position E482 is E482K; the modification at position D492 is D492H; the modification at position K500 is K500E; the modification at position D521 is D521K; the modification at position E523 is E523K; and the modification at position E537 is E537K.

In some embodiments, the modified recombinant enzyme comprises the amino acid sequence of SEQ ID NO: 88.

In some embodiments, the amino acid sequence of the modified recombinant enzyme comprises a modification at position E60. In some embodiments, the modification at E60 is E60L.

In some embodiments, the modified recombinant enzyme comprises the amino acid sequence of SEQ ID NO: 157.

In some embodiments, the modified recombinant enzyme further comprises a bis-biotin tag.

In some embodiments, the modified recombinant enzyme comprises the amino acid sequence of SEQ ID NO: 180.

In some aspects, the disclosure relates to modified recombinant enzymes comprising an amino acid sequence comprising: (i) a first segment, a second segment, a third segment, a fourth segment, a fifth segment, a sixth segment, and a seventh segment; and (ii) a modification at one or more positions corresponding to E139, E142, N145, I148, D167, D171, D189, D374, E385, E391, N467, E482, D492, K495, D521, E523, D533, E537, and E545 of SEQ ID NO: 2; wherein the first segment comprises an amino acid sequence that is at least 80%, 80-90%, 90-95%, or at least 95% identical to a exonuclease region of a polymerizing enzyme of Table 1, Table 2, or Table 3; the second segment and the sixth segment collectively comprise an amino acid sequence that is at least 80%, 80-90%, 90-95%, or at least 95% identical to a palm region of a polymerizing enzyme of Table 1, Table 2, or Table 3; the third segment comprises an amino acid sequence that is at least 80%, 80-90%, 90-95%, or at least 95% identical to a TPR1 region of a polymerizing enzyme of Table 1, Table 2, or Table 3; the fourth segment comprises an amino acid sequence that is at least 80%, 80-90%, 90-95%, or at least 95% identical to a finger region of a polymerizing enzyme of Table 1, Table 2, or Table 3; the fifth segment comprises an amino acid sequence that is at least 80%, 80-90%, 90-95%, or at least 95% identical to a TPR2 region of a polymerizing enzyme of Table 1, Table 2, or Table 3; and the seventh segment comprises an amino acid sequence that is at least 80%, 80-90%, 90-95%, or at least 95% identical to a thumb region of a polymerizing enzyme of Table 1, Table 2, or Table 3. In particular embodiments, a polymerizing enzyme from Table 1 is selected from any one of SEQ ID Nos: 2-5. In some embodiments, a polymerizing enzyme from Table 1 is selected from any one of SEQ ID NOs: 23-33.

In some embodiments, a modification is an amino acid substitution selected from the group consisting of E139K, E139Q, E139R, E139H, E142K, E142H, E142R, E142Q, N145K, N145H, N145R, I148K, I148H, I148R, D167P, D167K, D167H, D167R, D171K, D171H, D171R, D189K, D189H, D189R, D374G, D374Q, D374H, E385Y, E385K, E385R, E385N, E385Q, E385L, E385A, E391Y, E391W, E391K, E391F, N467R, N467K, N467H, N467S, N467T, E482K, E482H, E482R, D492H, D492K, D492R, K495R, D521K, D521H, D521R, E523K, E523Y, E523H, E523R, E523F, E523W, D533A, D533Q, D533T, D533R, D533S, E537K, E537H, E537R, E545K, E545H, and E545R. In some embodiments, the modified recombinant enzyme further comprises a modification at one or more positions corresponding to K4, T13, S22, V25, C26, D27, N33, I34, F36, S42, D54, N59, E60, E65, E85, M95, N106, T110, T114, K119, Q122, Y133, P136, P147, E152, I153, P160, N175, F188, Q206, T211, S216, R217, D232, A236, V247, I253, V261, L264, S267, P273, P275, R308, V315, Q317, S319, L320, I322, Q323, D337, E338, D341, T345, F352, F353, T364, I384, N388, A396, N397, G400, D414, D425, R429, E436, L437, V443, L445, A446, S447, V449, T450, W452, G453, Y455, F465, T479, A484, E485, A486, L490, 5493, K500, S503, Q506, Q513, E519, V526, R534, G547, L555, P556, R558, T559, V564, T568, M569, and T571 of SEQ ID NO: 2. In some embodiments, a modification is an amino acid substitution selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, P147Q, P147T, E152D, I153V, P160A, N175T, N175Y, F188C, Q206R, Q206K, Q206H, T211A, S216G, S216R, R217G, D232K, A236G, V247D, I253H, I253A, V261A, V261I, V261L, L264H, L264A, L264M, S267A, P273S, P273R, P275S, E283K, V315L, S319R, R308G, G308R, Q317R, S319R, L320M, L320T, I322K, Q323G, Q323V, Q323R, D337G, E338K, D341T, T345I, F352I, F353C, T364I, I384T, I384F, I384S, N388T, A396Q, N397L, G400L, D414V, D425N, R429G, E436R, E436G, L437Y, L437E, V443T, L445M, A446G, S447V, V449I, T450A, W452Y, G453A, Y455W, F465Y, T479V, A484E, E485D, A486E, L490M, S493P, K500E, S502A, S503T, Q506K, Q513D, V526L, R534K, G547S, L555K, L555R, P556A, R558H, T559V, V564L, T568D, T568S, M569K, M569T, M569V, and T571S.

In some embodiments, the modified recombinant enzyme comprises a combination of modifications listed in Table 7.

In some aspects, the disclosure relates to modified recombinant enzymes comprising: an amino acid sequence this is at least 60%, 60-70%, 70-80%, or at least 80% identical to SEQ ID NO: 2; and an extended palm domain, wherein the extended palm domain comprises an addition of an amino acid sequence that is at least 80%, 80-90%, 90-95%, or at least 95% identical to amino acids 505-524 of SEQ ID NO: 1.

In some embodiments, the modified recombinant enzyme further comprises a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, N145H, N145R, P147, I148, E152, I153, P160, D167, D171, N175, F188, D189, Q206, T211, S216, R217, D232, A236, V247, I253, V261, L264, S267, V443, L445, A446, S447, V449, T450, W452, G453, Y455, F465, N467, T479, E482, A484, E485, A486, L490, D492, S493, K495, K500, S503, Q506, Q513, E519, D521, E523, and V526 of SEQ ID NO: 2. In some embodiments, a modification is an amino acid substitution selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, N145H, N145R, P147Q, P147T, I148K, I148H, I148R, E152D, I153V, P160A, D167P, D167K, D167H, D167R, D171K, D171H, D171R, N175T, N175Y, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S503A, S503T, Q506K, Q513D, D521K, D521R, D521H, E523R, E523V, E523Y, E523F, E523H, E523W, and V526L. In some embodiments, the amino acid sequence of the modified recombinant enzyme further comprises a modification at one or more positions corresponding to E139, E142, N145, I148, D167, D171, D189, N467, E482, D492, K495, D521, and E523. In some embodiments, a modification is an amino acid substitution selected from the group consisting of E139K, E139Q, E139R, E139H, E142K, E142H, E142R, E142Q, N145K, N145H, N145R, I148K, I148H, I148R, D167P, D167K, D167H, D167R, D171K, D171H, D171R, D189K, D189H, D189R, N467R, N467K, N467H, N467S, N467T, E482K, E482H, E482R, D492H, D492K, D492R, K495R, D521K, D521H, D521R, E523K, E523Y, E523H, E523R, E523F, and E523W.

In some embodiments, the amino acid sequence of the modified recombinant enzyme comprises a modification at one or more positions corresponding to P273, P275, R308, V315, Q317, S319, L320, I322, Q323, D337, E338, D341, T345, F352, F353, T364, D374, I384, E385, N388, E391, A396, N397, G400, D414, D425, R429, E436, L437, D533, R534, E537, G547, E545, L555, P556, R558, T559, V564, T568, M569, and T571 of SEQ ID NO: 2. In some embodiments, a modification is an amino acid substitution selected from the group consisting of P273S, P273R, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, D374Q, D374H, I384T, I384F, I384S, E385Y, E385K, E385R, E385N, E385Q, E385L, E385A, N388T, E391Y, E391W, E391F, E391H, E391M, E391K, E391R, A396Q, N397L, G400L, D414V, D425N, R429G, E436R, E436G, L437Y, L437E, D533A, D533Q, D533T, D533R, D533S, R534K, E537K, E537H, E537R, E545K, E545H, E545R, G547S, L555K, L555R, P556A, R558H, T559V, V564L, T568D, T568S, M569K, M569T, M569V, and T571S. In some embodiments, a modification is an amino acid substitution selected from the group consisting of D374G, D374Q, D374H, E385Y, E385K, E385R, E385N, E385Q, E385L, E385A, E391Y, E391W, E391K, E391F, D533A, D533Q, D533T, D533R, D533S, E537K, E537H, E537R, E545K, E545H, and E545R.

In some embodiments, the modified recombinant enzyme comprises a combination of modifications listed in Table 7.

In some aspects, the disclosure relates to modified recombinant enzymes having an amino acid sequence that is at least 60%, 60-70%, 70-80%, or at least 80% identical to any one of SEQ ID NOs: 1-33, wherein the amino acid sequence comprises a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, and T571 of E. faecium polymerase (SEQ ID NO: 2). In particular embodiments, a modified recombinant enzyme has an amino acid sequence that is at least 60%, 60-70%, 70-80%, or at least 80% identical to any one of SEQ ID NOs: 2-5 and comprises a modification at one or more of the above positions. In a particular embodiment, a modified recombinant enzyme is a modified E. faecium polymerase that has an amino acid sequence that is at least 60%, 60-70%, 70-80%, or at least 80% identical to any one of SEQ ID NO: 2 and comprises a modification at one or more of the above positions. In a particular embodiments, a modified recombinant enzyme is a modified E. faecium polymerase that comprises the amino acid sequence of SEQ ID NO: 2 and comprises a modification at one or more of the positions. In some embodiments, a modified recombinant enzyme has an amino acid sequence that is 60%, 60-70%, 70-80%, or at least 80% identical to any one of SEQ ID NOs: 23-33, and comprises a modification at one or more of the above positions.

In some embodiments, the modified recombinant enzyme comprises a modification at one or both positions corresponding to T568 and M569 of SEQ ID NO: 2. In some embodiments, the modification is an amino acid substitution selected from the group consisting of T568D, T568S, M569T, and M569V. In some embodiments, the modified recombinant enzyme has improved processivity relative to E. faecium polymerase (SEQ ID NO: 2).

In some embodiments, the modified recombinant enzyme comprises a modification at a position corresponding to N59 of SEQ ID NO: 2. In some embodiments, the modification is N59D. In some embodiments, the modified recombinant enzyme has altered exonuclease activity relative to E. faecium polymerase (SEQ ID NO: 2).

In some embodiments, the modified recombinant enzyme comprises a modification at one or more positions corresponding to V261, L264, S267, I384, E391, W452, G453, Y455, D492, and K500 of SEQ ID NO: 2. In some embodiments, a modification is an amino acid substitution selected from the group consisting of V261A, V261I, L264A, L264H, L264M, S267A, I384F, I384S, E391Y, E391W, E391F, E391H, E391M, E391K, E391R, W452Y, G453A, Y455W, D492H, and K500E. In some embodiments, the modified recombinant enzyme has improved nucleotide substrate utilization relative to E. faecium polymerase (SEQ ID NO: 2).

In some embodiments, the modified recombinant enzyme comprises a modification at one or more positions corresponding to E65, Y133, V261, L264, S267, I384, E391, G400, V443, L445, A446, S447, V449, T450, W452, G453, Y455, K500, S503, E523, L555, and P556 of SEQ ID NO: 2. In some embodiments, a modification is an amino acid substitution selected from the group consisting of E65S, Y133L, V261A, V261I, L264A, L264H, S267A, I384F, I384S, E391Y, E391W, E391F, E391K, G400L, V443T, L445M, A446G, S447V, V449I, T450A, W452Y, G453A, Y455W, K500E, S502A, E523K, E523Y, E523F, E523H, E523W, L555K, and P556A. In some embodiments, the modified recombinant enzyme has improved accuracy relative to E. faecium polymerase (SEQ ID NO: 2).

In some embodiments, the modified recombinant enzyme comprises a modification at one or more positions corresponding to Q317, S319, I322, Q323, R429, L555, and T559 of SEQ ID NO: 2. In some embodiments, a modification is an amino acid substitution selected from the group consisting of Q317R, S319R, I322K, Q323G, R429G, L555K, and T559V. In some embodiments, the modified recombinant enzyme has an increased DNA-binding affinity relative to E. faecium polymerase (SEQ ID NO: 2).

In some embodiments, the modified recombinant enzyme comprises a modification at one or more positions corresponding to E391, S503 and E523 of SEQ ID NO: 2. In some embodiments, a modification is an amino acid substitution selected from the group consisting of E391Y, E391W, E391F, E391K, S502A, E523K, E523Y, E523F, E523H, and E523W. In some embodiments, the modified recombinant enzyme has an increased analog-binding affinity relative to E. faecium polymerase (SEQ ID NO: 2).

In some embodiments, the modified recombinant enzyme comprises a modification at one or more positions corresponding to Q206, E436 and L437 of SEQ ID NO: 2. In some embodiments, a modification is an amino acid substitution selected from the group consisting of Q206R, Q206K, Q206H, E436R, L437Y, and L437E. In some embodiments, the modified recombinant enzyme has improved strand displacement relative to E. faecium polymerase (SEQ ID NO: 2).

In some embodiments, the modified recombinant enzyme comprises a modification at one or more positions corresponding to E436, L437, R534, T568, and M569 of SEQ ID NO: 2. In some embodiments, a modification is an amino acid substitution selected from the group consisting of E436R, L437Y, L437E, R534K, T568D, T568S, M569T, and M569V. In some embodiments, the modified recombinant enzyme has an enhanced average read length relative to E. faecium polymerase (SEQ ID NO: 2).

In some embodiments, the modified recombinant enzyme comprises a modification at one or more positions corresponding to T13, V25, C26, D27, N33, I34, F36, S42, D54, E60, M95, T110, T114, K119, P136, P147, E152, I153, P160, N175, F188, 5216, R217, D232, A236, V247, P273, P275, P283, V315, S319, L320, Q323, E338, T345, F352, F353, T364, D414, D425, E436, F465, E485, A486, L490, S503, E523, V526, G547, L555, R558, V564, M569, and T571 of SEQ ID NO: 2. In some embodiments, a modification is an amino acid substitution selected from the group consisting of T13N, V25L, C26W, D27E, N33T, I34V, F36V, S42T, D54Y, E60V, M95T, M95K, T110I, T114S, K119Q, P136T, P147Q, P147T, E152D, I153V, P160A, N175Y, F188C, S216G, S216R, R217G, D232H, A236G, V247D, P273R, P275S, E283K, V315L, S319R, L320M, L320T, Q323R, E338K, T345I, F352I, F353C, T364I, D414V, D425N, E436G, F465Y, E485D, A486E, L490M, S503T, E523V, V526L, G547S, L555R, R558H, V564L, M569K, and T571S. In some embodiments, the modified recombinant enzyme has an increased replication capacity relative to *E. faecium* polymerase (SEQ ID NO: 2).

In some embodiments, the modified recombinant enzyme comprises a modification at one or more positions corresponding to E139, E142, N145, I148, D167, D171, D189, D374, E385, E391, N467, E482, D492, K495, D521, E523, D533, E537, and E545 of SEQ ID NO: 2. In some embodiments, a modification is an amino acid substitution selected from the group consisting of E139K, E139Q, E139R, E139H, E142K, E142H, E142R, E142Q, N145K, N145H, N145R, I148K, I148H, I148R, D167P, D167K, D167H, D167R, D171K, D171H, D171R, D189K, D189H, D189R, D374G, D374Q, D374H, E385Y, E385K, E385R, E385N, E385Q, E385L, E385A, E391Y, E391W, E391K, E391F, N467R, N467K, N467H, N467S, N467T, E482K, E482H, E482R, D492H, D492K, D492R, K495R, D521K, D521H, D521R, E523K, E523Y, E523H, E523R, E523F, E523W, D533A, D533Q, D533T, D533R, D533S, E537K, E537H, E537R, E545K, E545H, and E545R. In some embodiments, the modified recombinant enzyme has an increased electropositive surface charge relative to *E. faecium* polymerase (SEQ ID NO: 2).

In some embodiments, the modified recombinant enzyme comprises a modification at one or more positions corresponding to K4, S22, D27, I34, D54, E60, E85, M95, N106, T110, Q122, Y133, P136, P147, D167, T211, D232, P275, R308, S319, L320, E323, D337, E338, D341, T345, F352, T364, D414, F465, T479, E485, L490, S493, Q513, and R558 of SEQ ID NO: 2. In some embodiments, a modification is an amino acid substitution selected from the group consisting of K4R, S22A, D27E, I34V, D54Y, E60V, E60L, E85P, M95K, T110I, N106G, Q122V, Y133L, P136T, P147Q, P147T, D167P, T211A, D232K, P275S, R308G, S319R, L320M, Q323V, D337G, E338K, D341T, T345I, F352I, T364I, D414V, F465Y, T479V, E485D, L490M, S493P, Q513D, and R558H. In some embodiments, the modified recombinant enzyme has an increased stability relative to *E. faecium* polymerase (SEQ ID NO: 2).

In some embodiments, the modified recombinant enzyme comprises a combination of modifications listed in Table 7.

A modified polymerase may include one or more modifications (e.g., a deletion of one or more amino acids, an addition of one or more amino acids, a substitution of one or more amino acids as described in this application, or a combination thereof) relative to a wild-type polymerase (e.g., a sequence of Table 1, e.g., SEQ ID NO: 1, SEQ ID Nos: 2-5, SEQ ID Nos: 6-22, or SEQ ID Nos: 23-33), or relative to a sequence described in any of Tables 2-7.

In some embodiments, the only modifications in a modified polymerase are one or more of the modifications (e.g., amino acid substitutions) provided in this disclosure and the sequence of the polymerase is otherwise identical to a wild-type polymerase (e.g., a sequence of TABLE 1) or to a sequence described in any of TABLES 2-7.

In some embodiments, a modified recombinant enzyme further comprises a purification tag. In some embodiments, the purification tag is covalently bound to a region within the polymerizing enzyme sequence. In some embodiments, the purification tag is covalently bound at a terminal end of the polymerizing enzyme sequence. In some embodiments, the purification tag is a C-terminal tag. In some embodiments, the purification tag is an N-terminal tag. In some embodiments, the purification tag is a His tag (e.g., a sequence of repeating histidine residues, such as a hexahistidine sequence).

In some embodiments, a modified recombinant enzyme further comprises a coupling group. In some embodiments, the coupling group is attached at a region within the modified recombinant enzyme sequence. In some embodiments, the coupling group is attached at a terminal end of the modified recombinant enzyme. In some embodiments, the coupling group is attached at a C-terminal end of the modified recombinant enzyme. In some embodiments, the coupling group is attached at an N-terminal end of the modified recombinant enzyme. In some embodiments, the coupling group is a biotinylation sequence. In some embodiments, the coupling group is a bis-biotinylation sequence. In some embodiments, a modified recombinant enzyme comprises (e.g., at its C terminus) a purification tag (e.g., a His tag) and a coupling group (e.g., a biotinylation or bis-biotinylation sequence) directly connected or separated by a peptide linker (e.g., 5-15 amino acids long or longer).

In some embodiments, a modified recombinant enzyme is immobilized on a surface. In some embodiments, the surface comprises a coupling group configured to bind the modified recombinant enzyme. In some embodiments, the surface comprises a nanoaperture. In some embodiments, the surface comprises a bottom surface of a sample well. In some embodiments, the sample well is disposed among a plurality of sample wells on a surface (e.g., a surface of a chip or an integrated device). In some embodiments, each of the plurality of sample wells are configured to receive a modified recombinant enzyme. In some embodiments, each of the plurality of sample wells comprising a modified recombinant enzyme are capable of conducting a single molecule sequencing reaction. In some embodiments, the surface can be a surface of a chip made from glass or other transparent material, silica, fused silica, silicon dioxide, a polymer, other material, or a combination thereof (e.g., a combination of different layers, for example including one or more metal layers).

In some aspects, the disclosure provides an isolated nucleic acid molecule that encodes a modified recombinant enzyme described herein. In some embodiments, the isolated nucleic acid molecule comprises RNA. In some embodiments, the isolated nucleic acid molecule comprises DNA. In some embodiments, the isolated nucleic acid molecule comprises a viral vector. In some embodiments, the isolated nucleic acid molecule comprises an expression vector. In some embodiments, the isolated nucleic acid molecule comprises a plasmid. In some embodiments, the isolated nucleic acid includes a promoter (e.g., an inducible promoter). In some embodiments, the isolated nucleic acid is in a host cell capable of expressing the modified recombinant enzyme. In some embodiments, the modified recombinant enzyme is isolated from the host cell (e.g., from a host cell preparation, for example after growth in a bioreactor and induction of an inducible promoter).

In some aspects, the disclosure provides a composition comprising a modified recombinant enzyme described in this application. In some embodiments, the composition is used in a method of sequencing a nucleic acid. In some embodiments, the composition further comprises a sequencing reaction mixture. In some embodiments, the sequencing reaction mixture can include one or more of a nucleoside polyphosphate (e.g., a nucleoside comprising more than one phosphate group, such as a nucleotide or a nucleoside hexaphosphate), a template nucleic acid to be sequenced, a nucleic acid primer that serves as a starting point for complementary strand synthesis, a divalent metal ion, a buffer component, and a salt. In some embodiments, the nucleoside polyphosphate comprises a detectable moiety (e.g., a luminescent label).

In some aspects, the disclosure provides a method of sequencing a nucleic acid by contacting a modified recombinant enzyme described in this application with a sequencing reaction mixture. In some embodiments, the sequencing reaction mixture can include one or more of a nucleoside polyphosphate (e.g., a nucleoside comprising more than one phosphate group, such as a nucleotide or a nucleoside hexaphosphate), a template nucleic acid to be sequenced, a nucleic acid primer that serves as a starting point for complementary strand synthesis, a divalent metal ion, a buffer component, and a salt. In some embodiments, the nucleoside polyphosphate comprises a luminescent label. In some embodiments, the method further comprises detecting incorporation of one or more nucleoside polyphosphates in a growing strand complementary to the template nucleic acid. In some embodiments, detecting comprises measuring one or more luminescent properties (e.g., lifetime, intensity, photon arrival time, quantum yield) of a luminescently labeled nucleoside polyphosphate involved in an incorporation event.

In some aspects, the disclosure relates to compositions comprising a modified recombinant enzyme described herein.

In some aspects, the disclosure relates to methods of sequencing a nucleic acid using a recombinant enzyme described herein. In some embodiments, the method comprises contacting the modified recombinant enzyme with a sequencing reaction mixture.

These and other aspects are described in more detail in the following detailed description and illustrated by the non-limiting drawings and examples.

BRIEF DESCRIPTION OF THE DRAWINGS

The skilled artisan will understand that the figures, described herein, are for illustration purposes only. It is to be understood that, in some instances, various aspects of the invention may be shown exaggerated or enlarged to facilitate an understanding of the invention. In the drawings, like reference characters generally refer to like features, functionally similar and/or structurally similar elements throughout the various figures. The drawings are not necessarily to scale, emphasis instead being placed upon illustrating the principles of the teachings. The drawings are not intended to limit the scope of the present teachings in any way.

The features and advantages of the present invention will become more apparent from the detailed description set forth below when taken in conjunction with the drawings.

When describing embodiments in reference to the drawings, direction references ("above," "below," "top," "bottom," "left," "right," "horizontal," "vertical," etc.) may be used. Such references are intended merely as an aid to the reader viewing the drawings in a normal orientation. These directional references are not intended to describe a preferred or only orientation of an embodied device. A device may be embodied in other orientations.

As is apparent from the detailed description, the examples depicted in the figures and further described for the purpose of illustration throughout the application describe non-limiting embodiments, and in some cases may simplify certain processes or omit features or steps for the purpose of clearer illustration.

Figure 1:
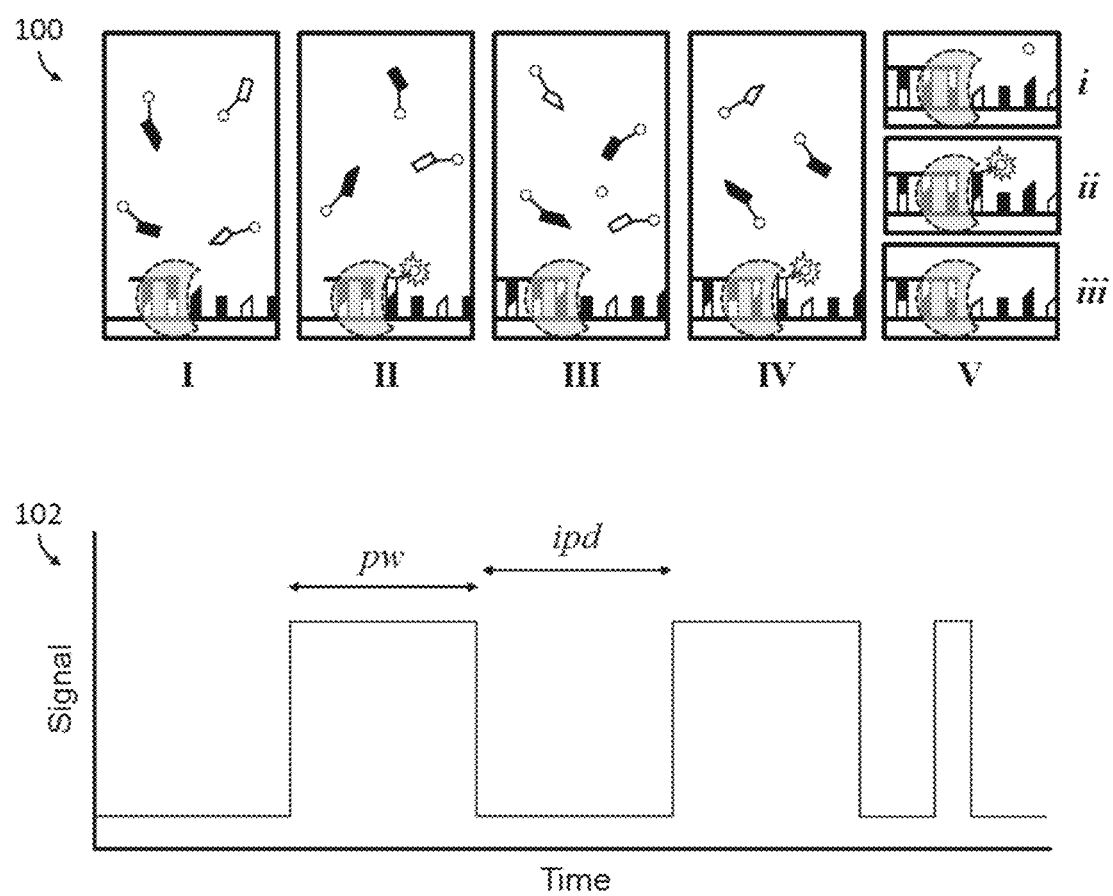

FIG. 1 is a schematic that illustrates the progression of a polymerization reaction in relation to signal readout in a non-limiting process for monitoring single molecule processes.

Figure 2:
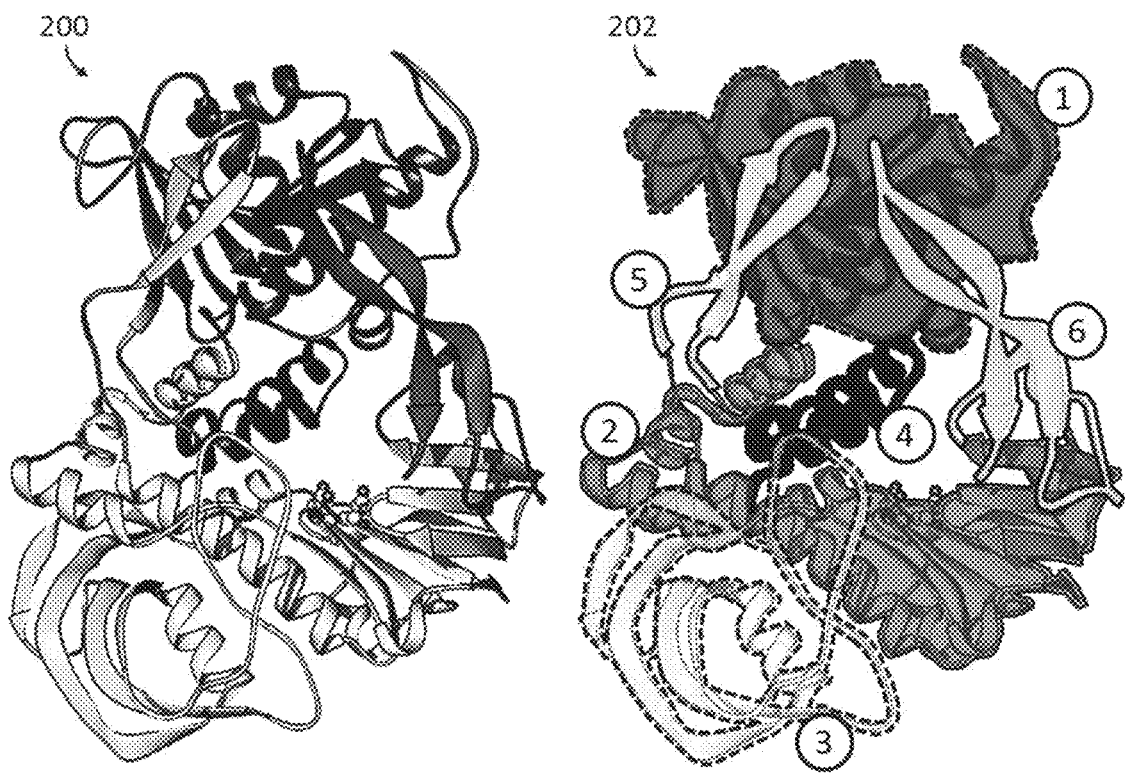
Figure 2:
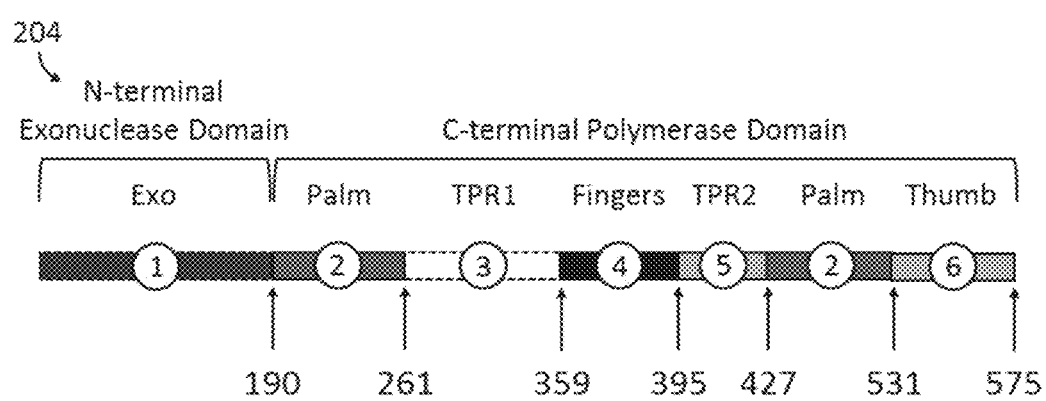

FIG. 2 is a non-limiting illustration that depicts the structure of Φ29 polymerase and domains and subdomains of the polymerase.

Figure 3:
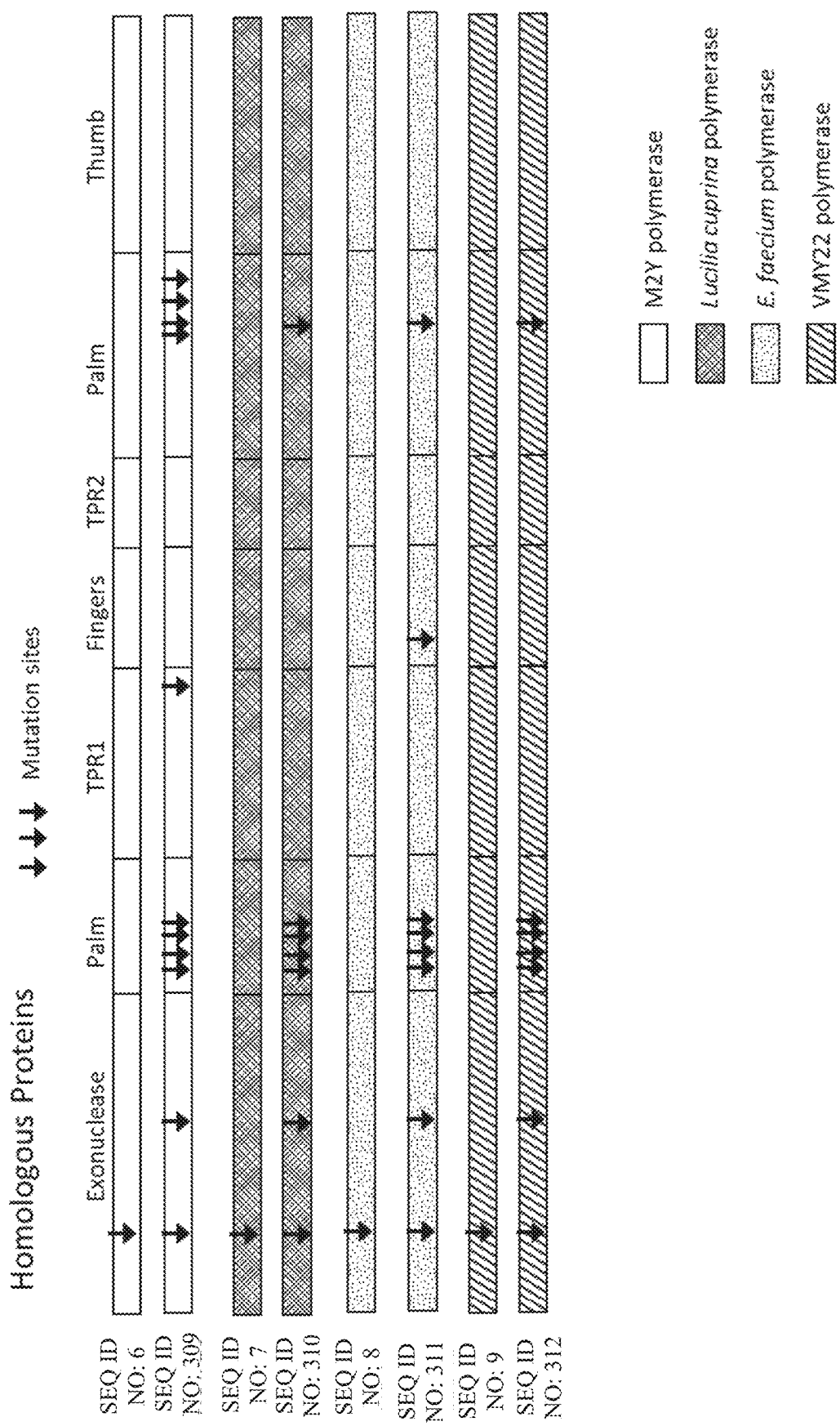

FIG. 3 depicts non-limiting examples of selected mutational variants with sites of mutation within domains and subdomains of polypeptide strands.

Figure 4:
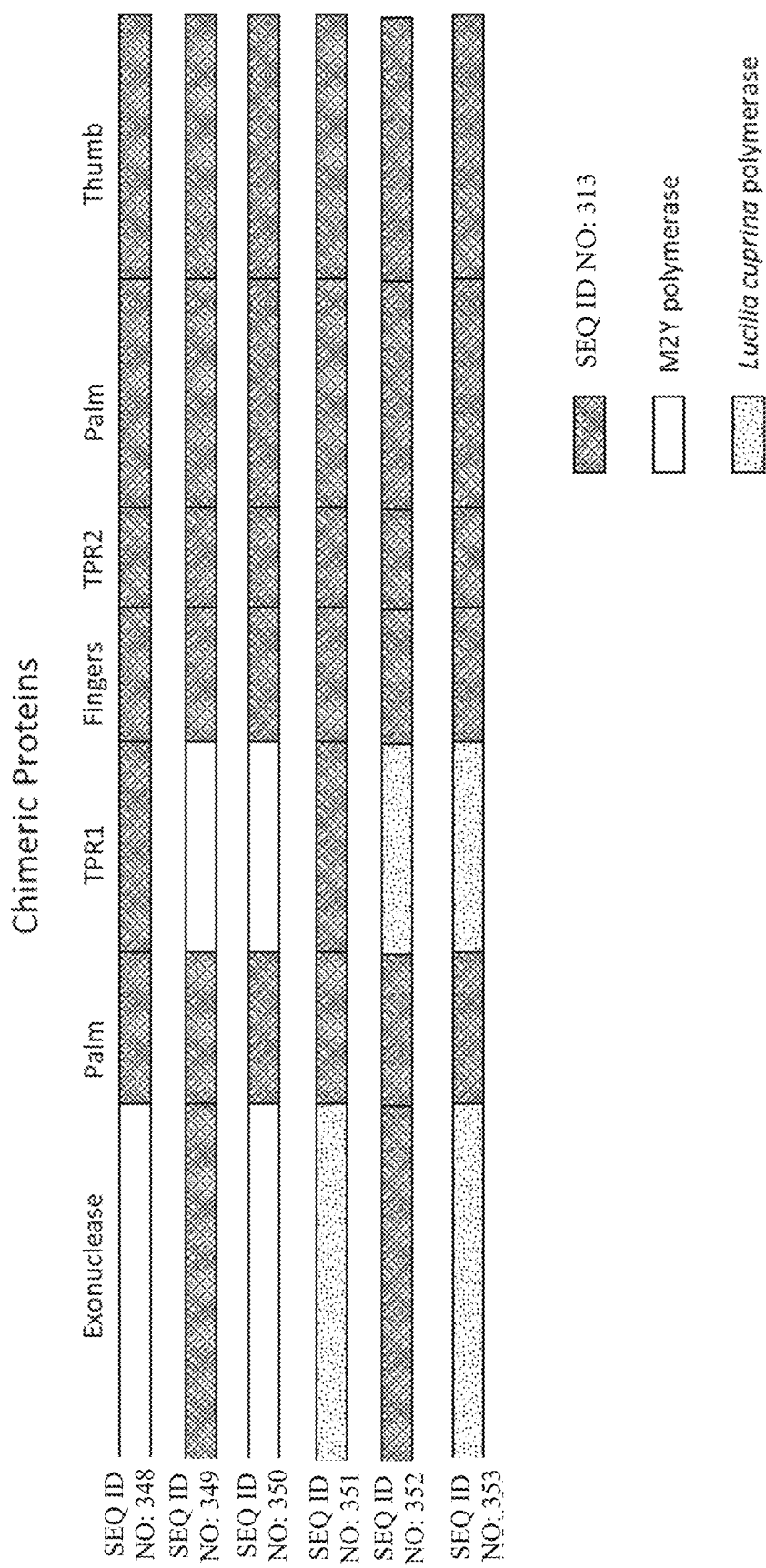

FIG. 4 depicts non-limiting examples of selected chimeric polymerase variants having different domains and subdomains substituted into the polypeptide strands.

Figure 5A:
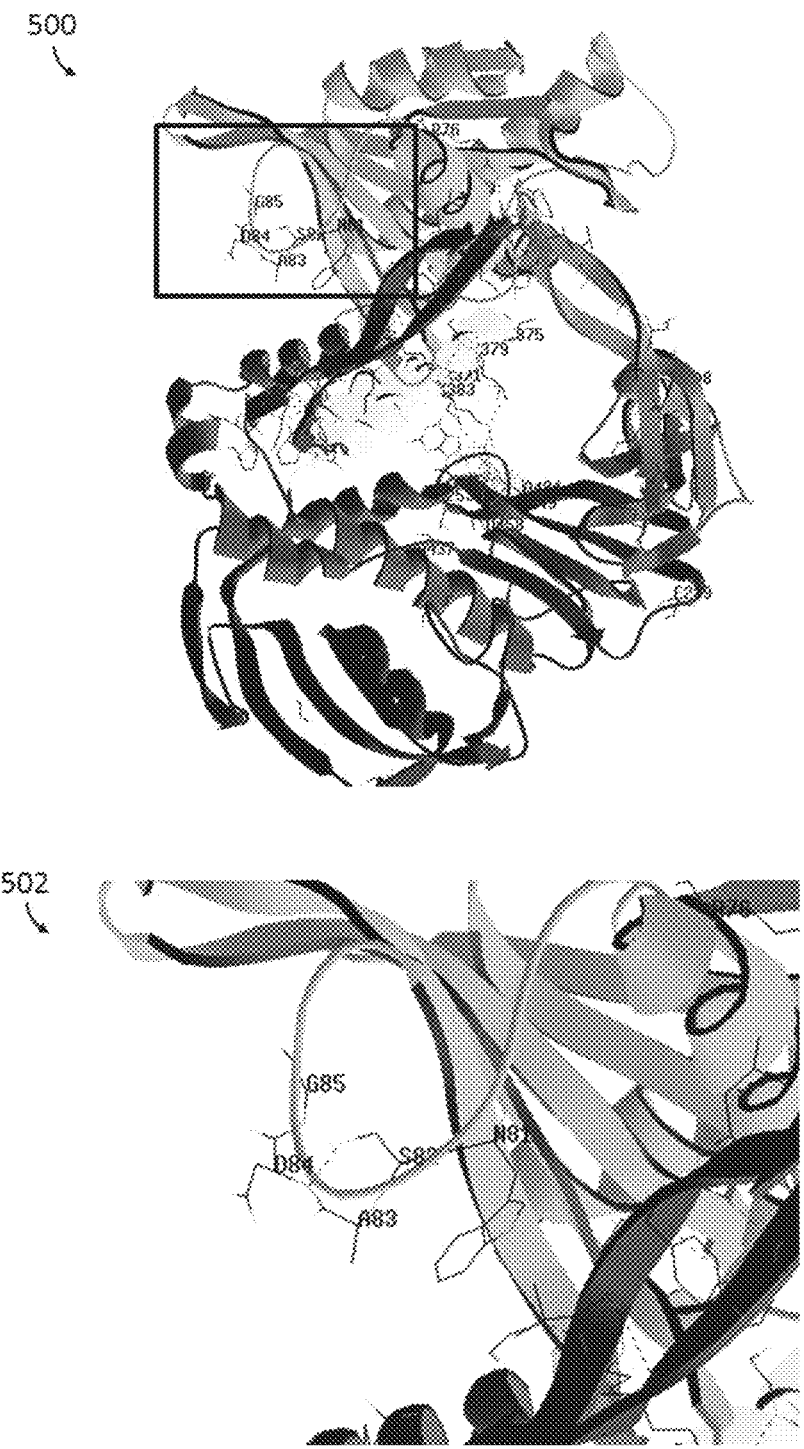

FIG. 5A is a non-limiting illustration that depicts a loop region in an exonuclease domain of Φ29 polymerase.

Figure 5B:
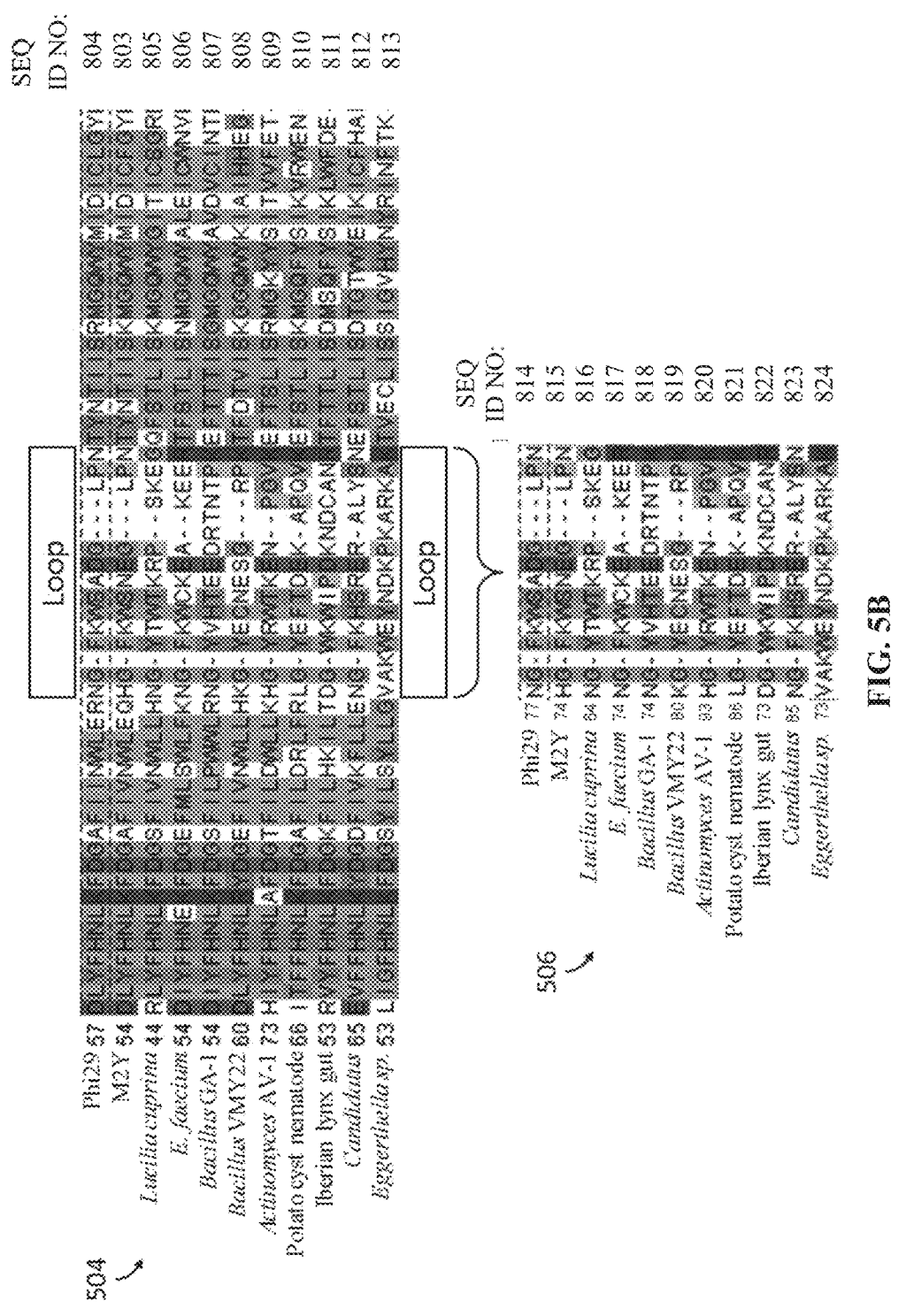

FIG. 5B depicts a sequence homology alignment between exonuclease regions of Φ29 polymerase and a non-limiting set of other polymerases.

Figure 6:
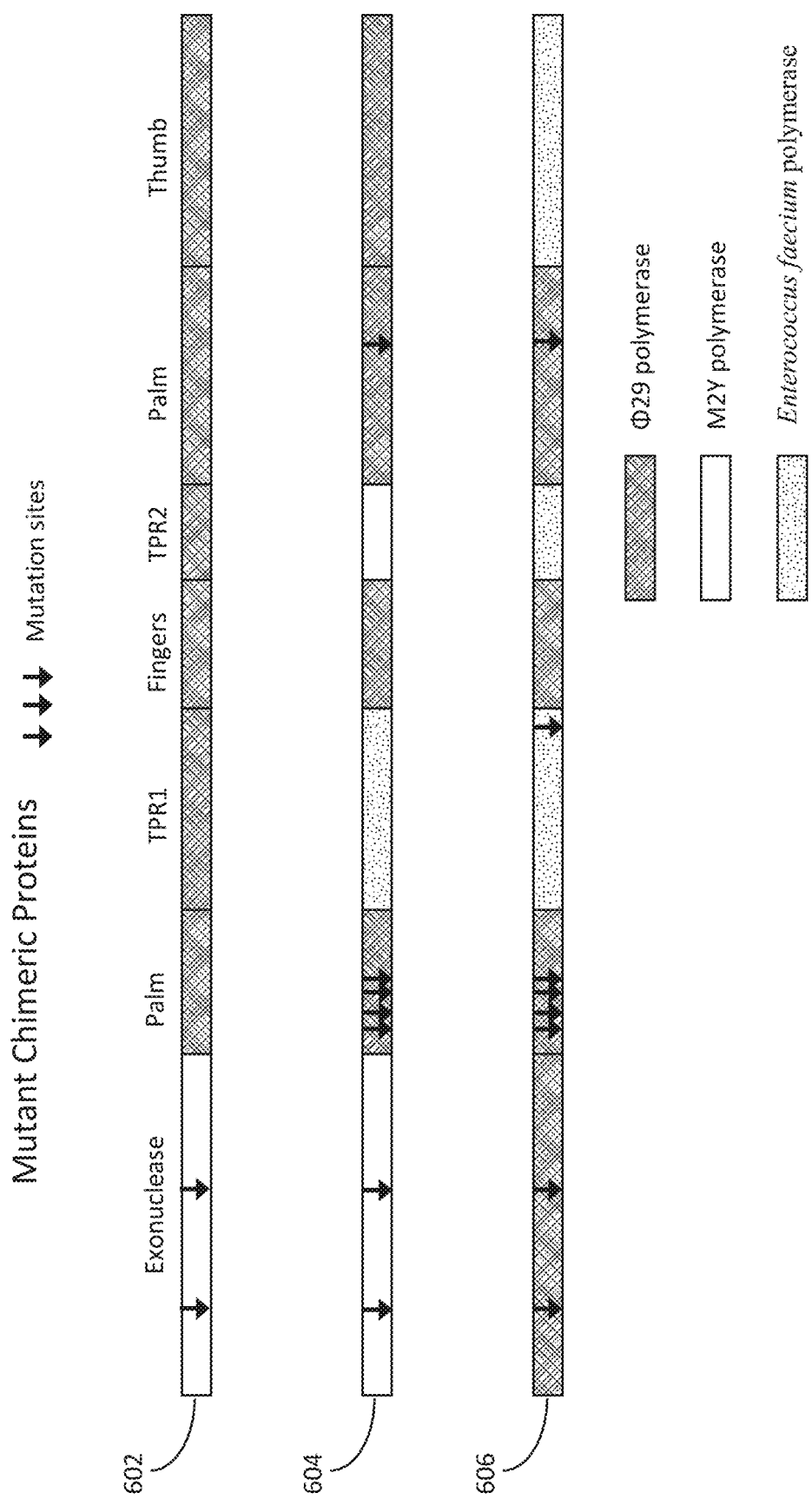

FIG. 6 depicts non-limiting generic examples of chimeric polymerase variants comprising one or more site-specific mutations.

Figure 7:
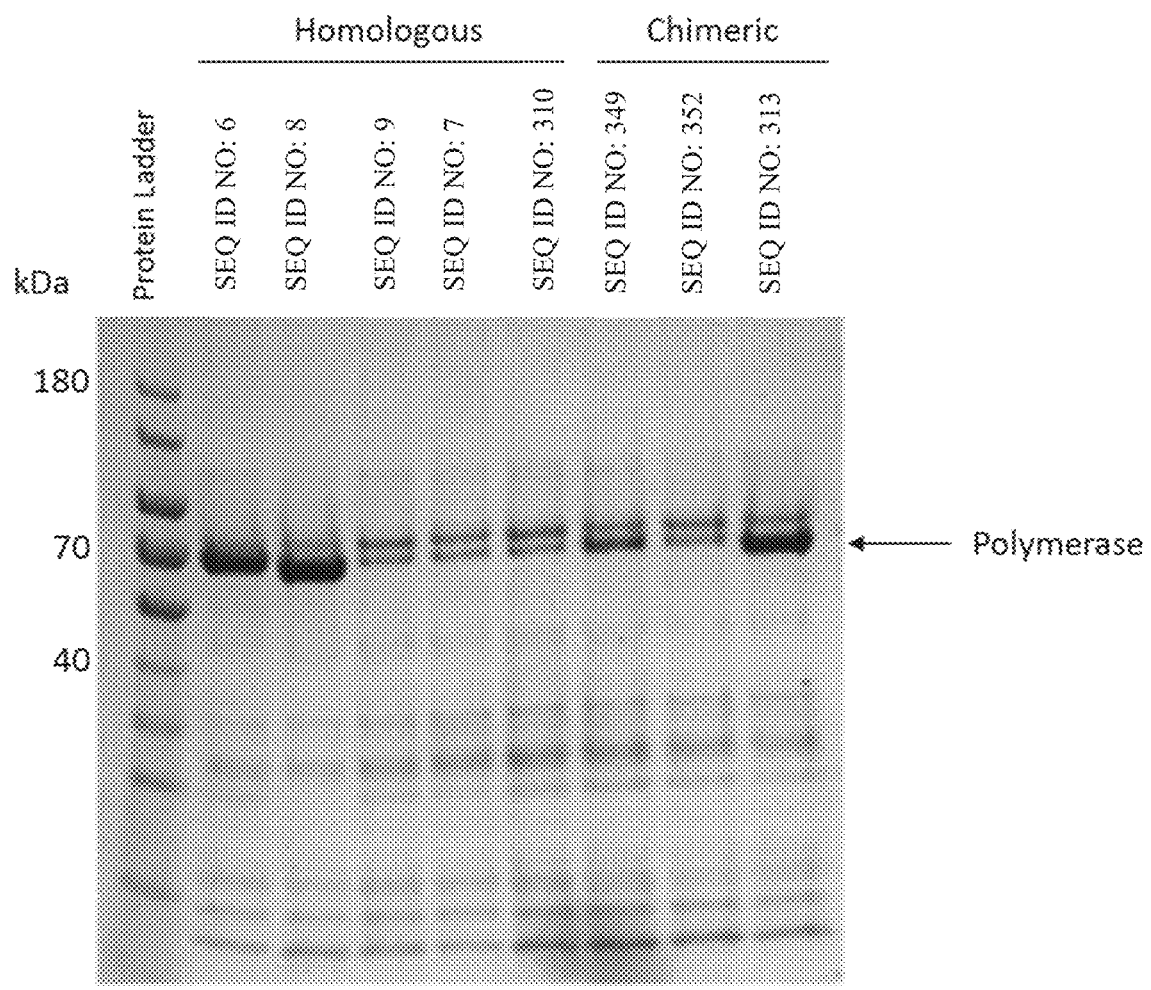

FIG. 7 is a picture of an SDS-PAGE conducted to evaluate purity of polymerases expressed in E. coli.

Figure 8A:
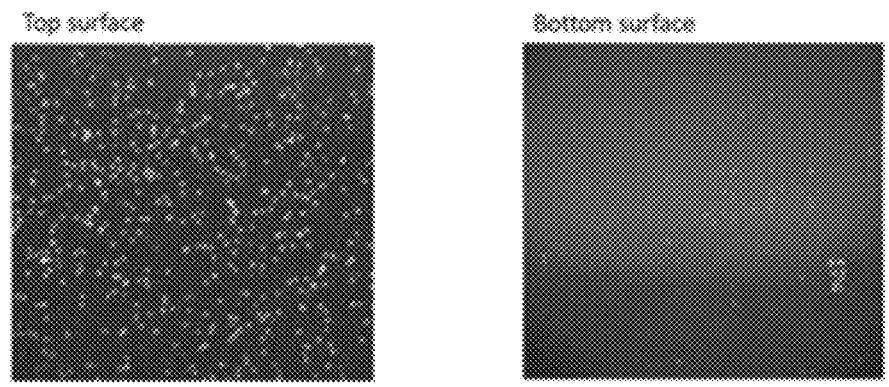
Figure 8B:
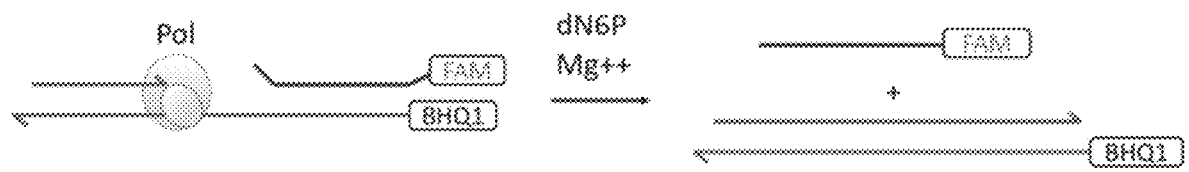
Figures 8C, 8D:
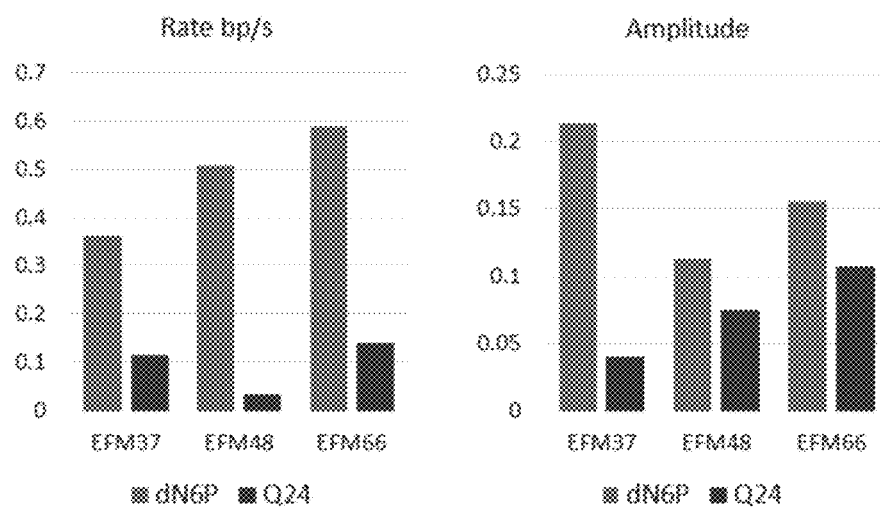

FIGS. 8A-8D show results from DNA synthesis experiments with E. faecium polymerase variants, EFM37, EFM48, and EFM66. FIG. 8A depicts sequencing chips loaded with EFM37-dumbbell ternary complexes. FIG. 8B illustrates a real-time stopped-flow strand-displacement DNA synthesis assay. FIG. 8C shows DNA synthesis rates determined for the different variants. FIG. 8D shows amplitudes determined for the different variants.

Figure 9A:
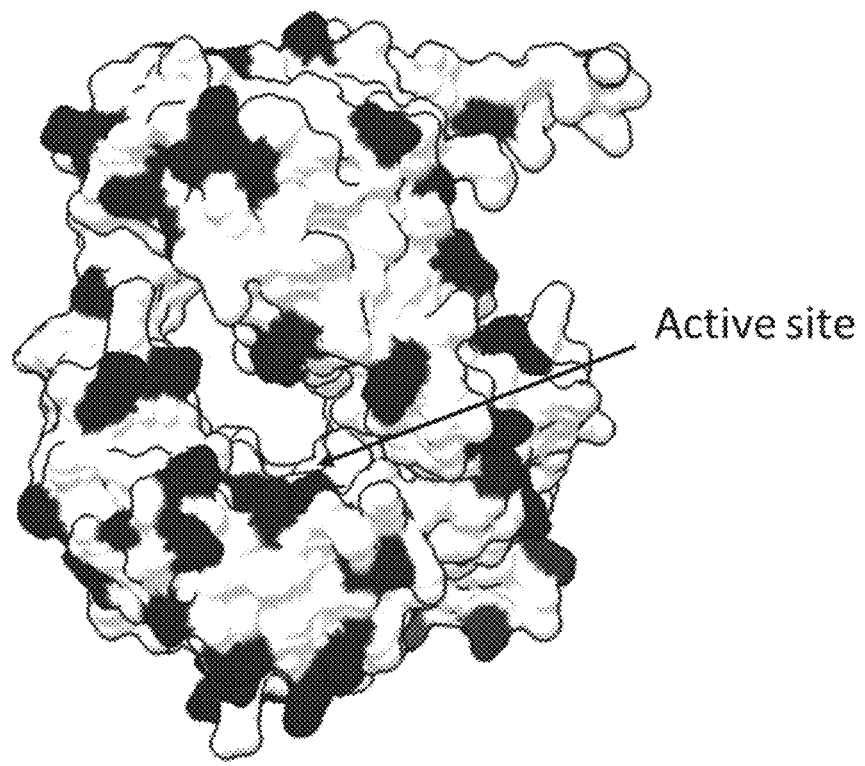
Figure 9B:
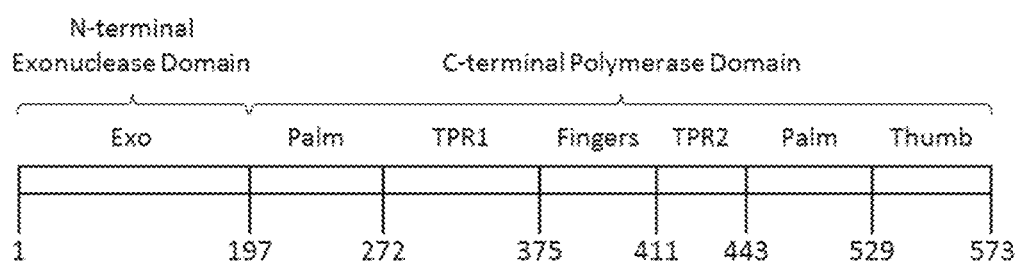

FIGS. 9A-9B show a structural characterization of wild-type E. faecium polymerase. FIG. 9A shows a modeled surface of wild-type E. faecium polymerase. FIG. 9B shows polymerase homology domains mapped to the wild-type E. faecium polypeptide.

Figure 10A:
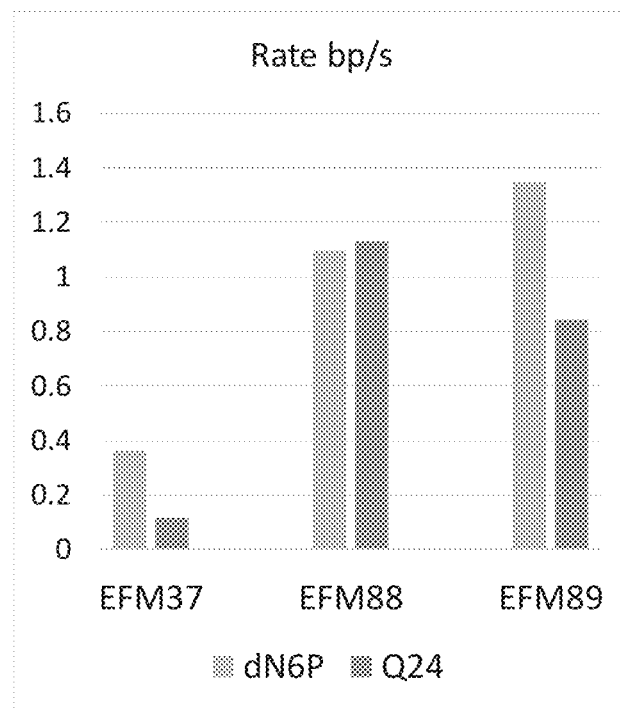
Figure 10B:
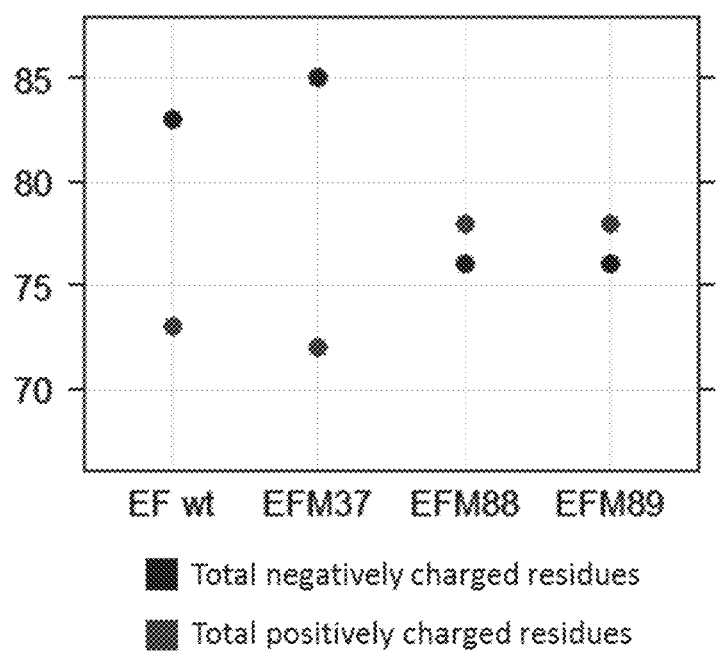
Figure 10C:
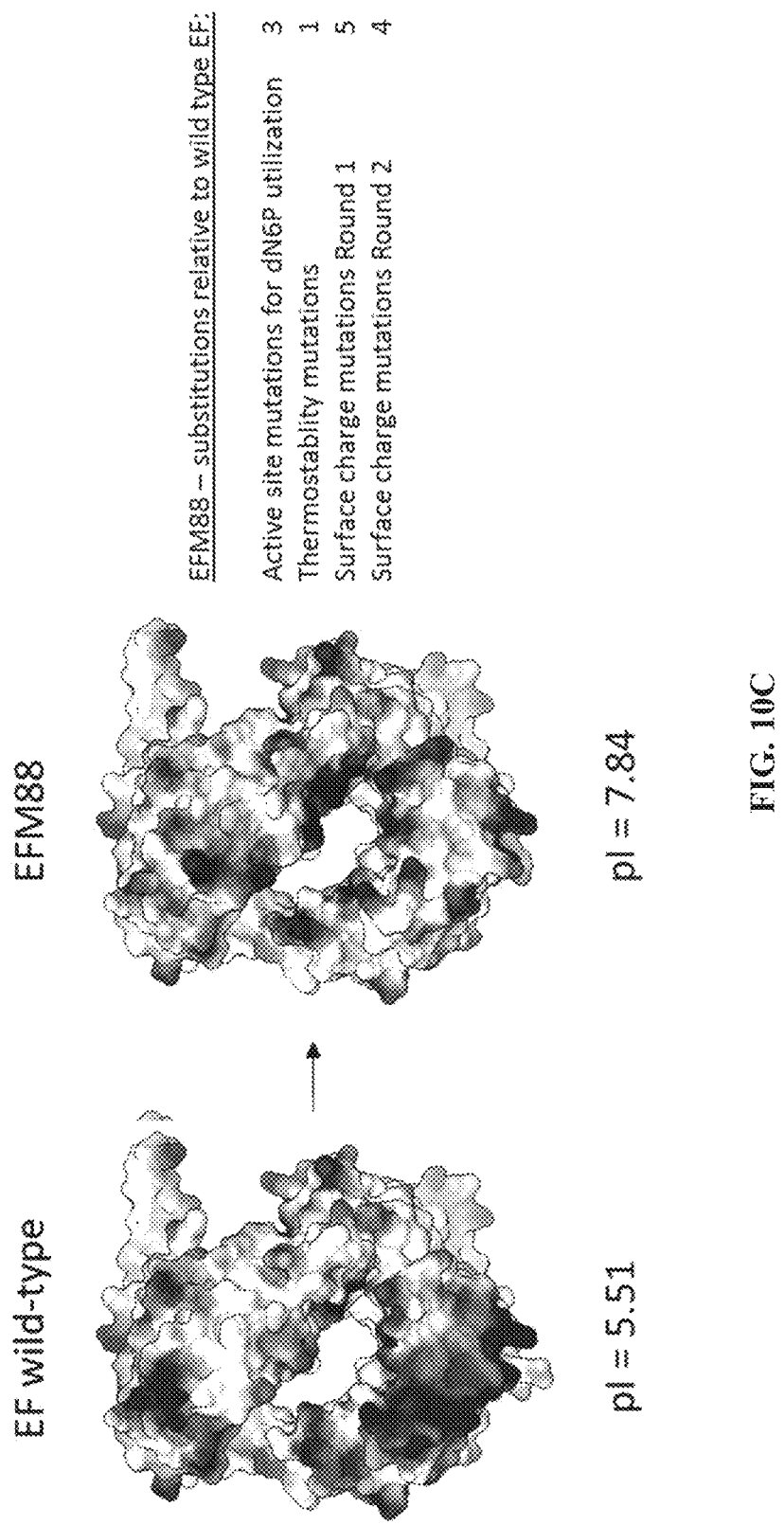
Figure 10D:
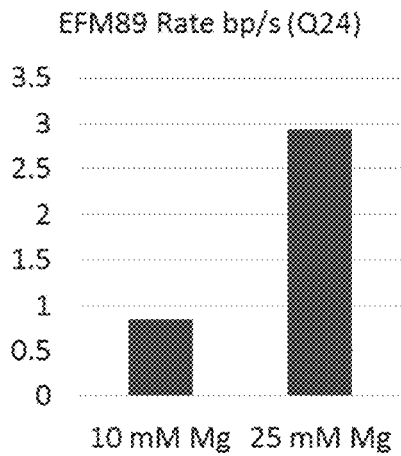
Figure 10E:
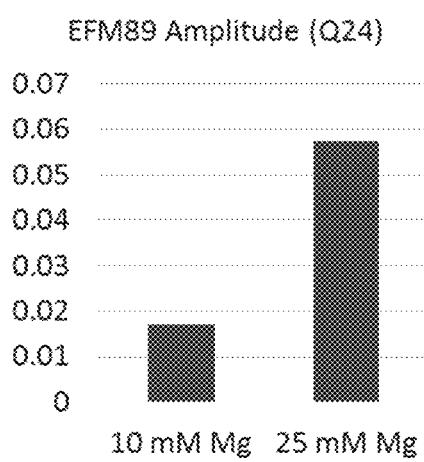
Figure 10F:
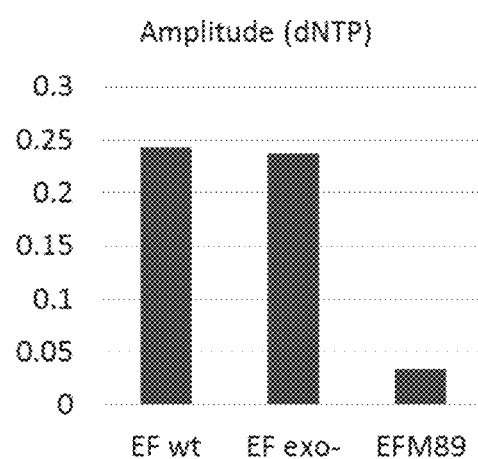

FIGS. 10A-10F show results from DNA synthesis experiments with E. faecium polymerase variants developed based on the EFM37 parent. FIG. 10A shows DNA synthesis rates determined for different variants in stopped-flow strand displacement synthesis assays with dN6P analogs and analogs containing duplex DNA linkers ("Q24"). FIG. 10B is a plot showing the number of negatively and positively charged residues in wild-type and variant polymerases. FIG. 10C depicts modeled electrostatic surfaces of wild-type and variant polymerases. FIGS. 10D-10E show improvements in EFM89 rate (FIG. 10D) and amplitude (FIG. 10E) with 25 mM vs 10 mM $MgCl_2$ in stopped-flow strand-displacement synthesis assays with Q24s. FIG. 10F shows amplitude of DNA synthesis using dNTP in stopped-flow strand displacement synthesis assays for wild-type EF, EF exo-, and EFM89 at 30° C. and 25 mM MgCl2.

Figure 11:
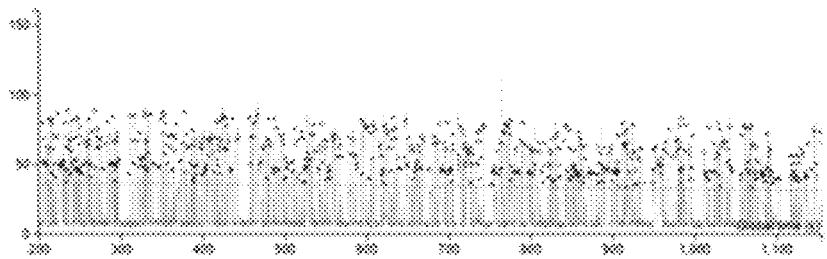

FIG. 11 shows an example sequencing alignment obtained from a sequencing reaction using EFM89 and M13 ssDNA plasmid template.

Figures 12A, 12B:
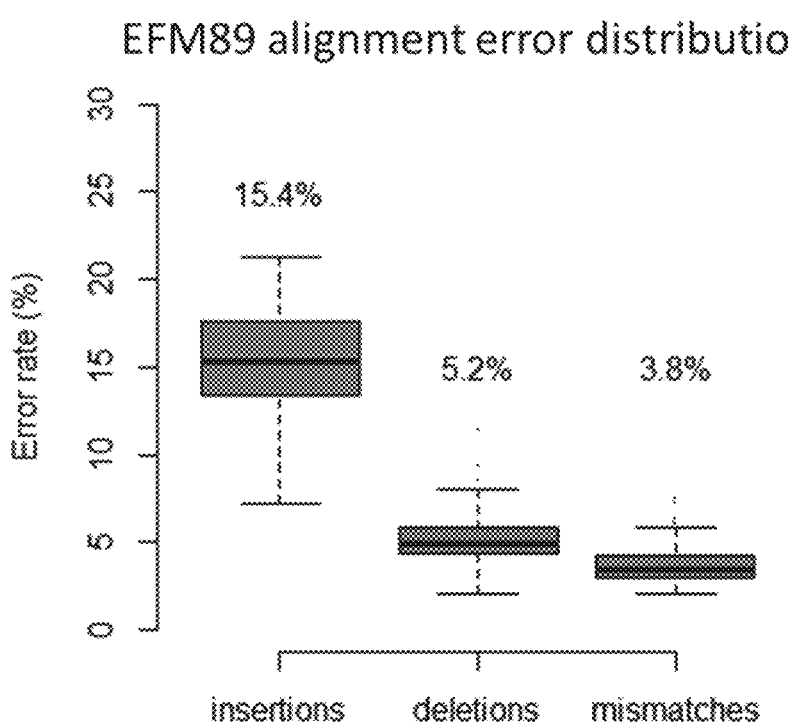

FIGS. 12A-12D shows results from DNA sequencing reactions on a commercial platform with two independent preparations of EFM89. FIG. 12A reports various output measurements. FIG. 12B shows boxplots indicating the distribution of insertion, deletion, and mismatch errors with EFM89, with average values indicated above each boxplot. FIG. 12C shows a histogram of total read length for EFM89 (batch 1). FIG. 12D shows a histogram of subread accuracy for EFM89 (batch 1).

FIGS. 13A-13B show sequence alignment results. FIG. 13A shows sequence identity between four naturally occurring E. faecium polymerase variants. FIG. 13B shows sequences identity shared between the variants. Sequences are listed by their NCBI protein database accession numbers.

Figures 14A, 14B:
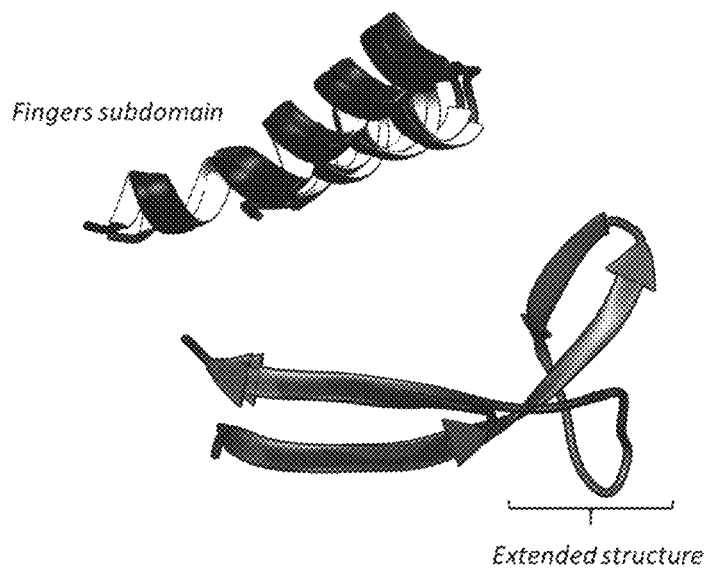

FIGS. 14A-14B show comparisons of *E. faecium* polymerase and Φ29. FIG. 14A shows an amino acid sequence alignment of the N-terminal ends of *E. faecium* polymerase and Φ29. FIG. 14B shows a crystal structure comparisons of the *E. faecium* polymerase and Φ29 fingers subdomain (top) and palm subdomain (bottom). Φ29 has an extended structure in the palm domain, which may be included in an *E. faecium* polymerase, for example, to provide favorable interactions with nucleotide analogs (e.g., dN6P utilization) and to provide a structural feature with closer proximity to the fingers domain when nucleotide analogs are bound.

Figure 15:
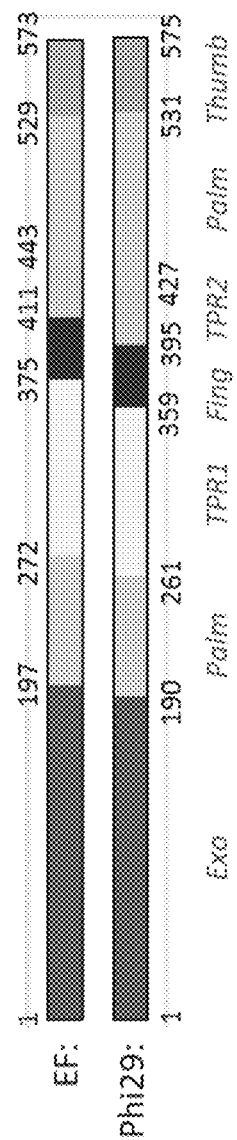

FIG. 15 shows domain organization of *E. faecium* polymerase relative to Φ29, with start positions of each domain indicated.

Figure 16:
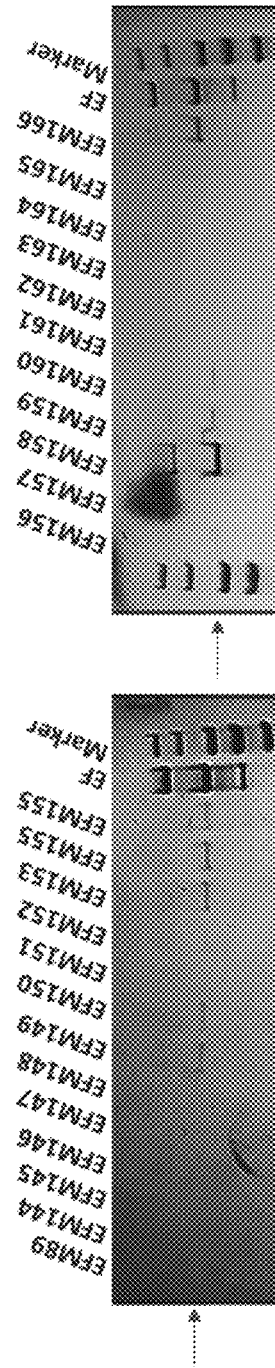
Figure 17L:
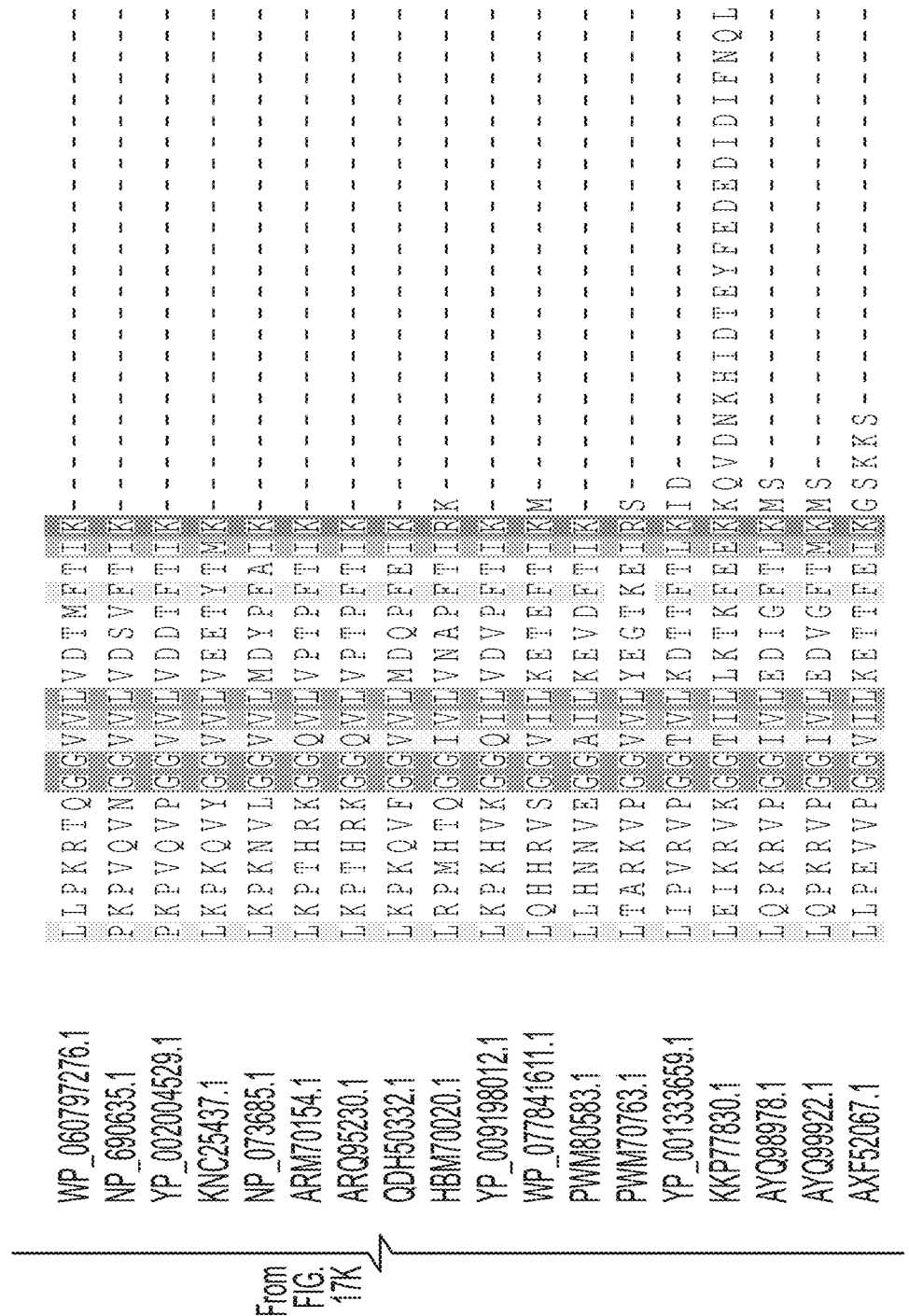

FIG. 16 is a picture of an SDS-PAGE conducted to evaluate purity of the indicated polymerases.

Figure 17A:
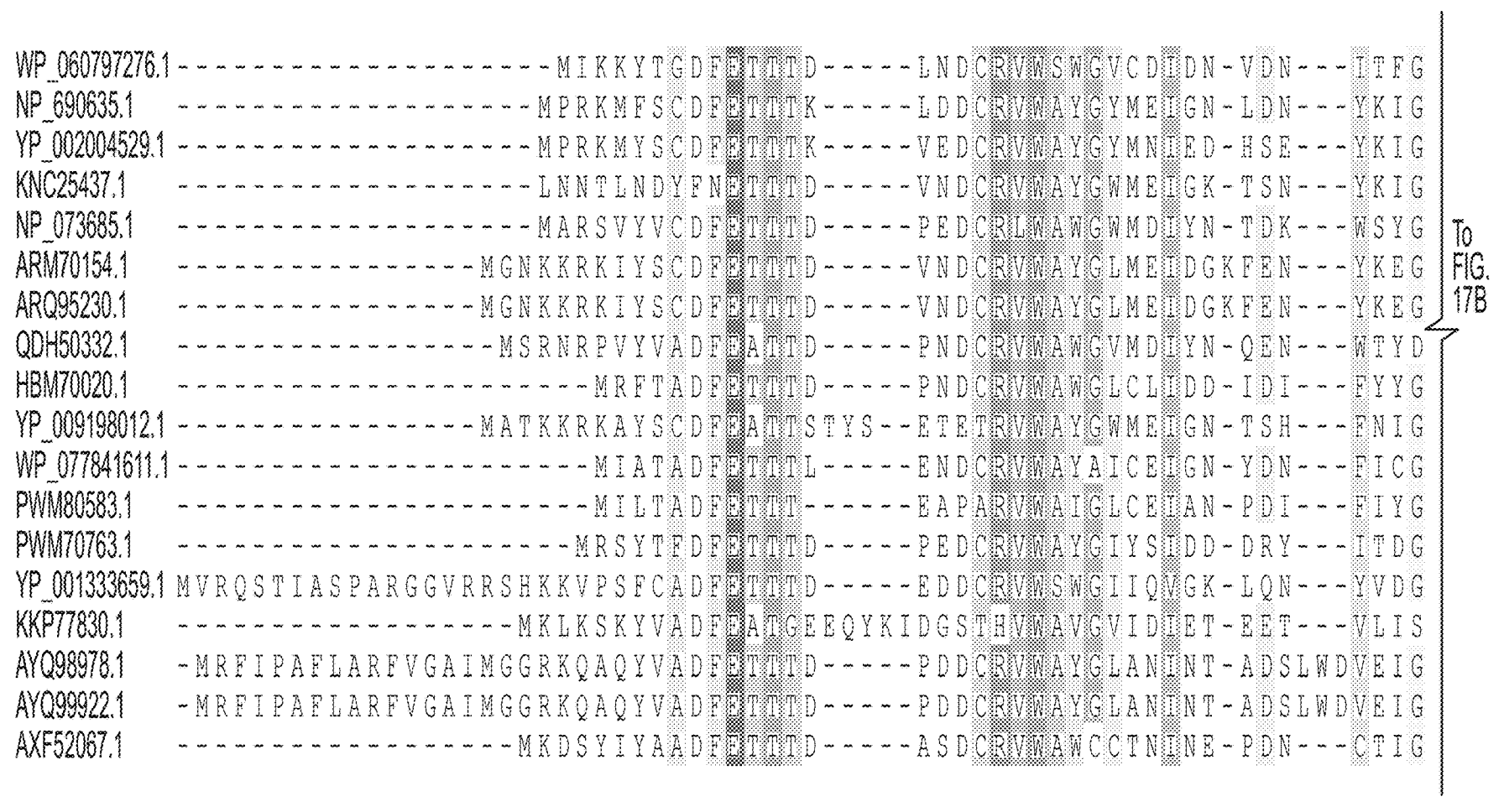
Figure 17B:
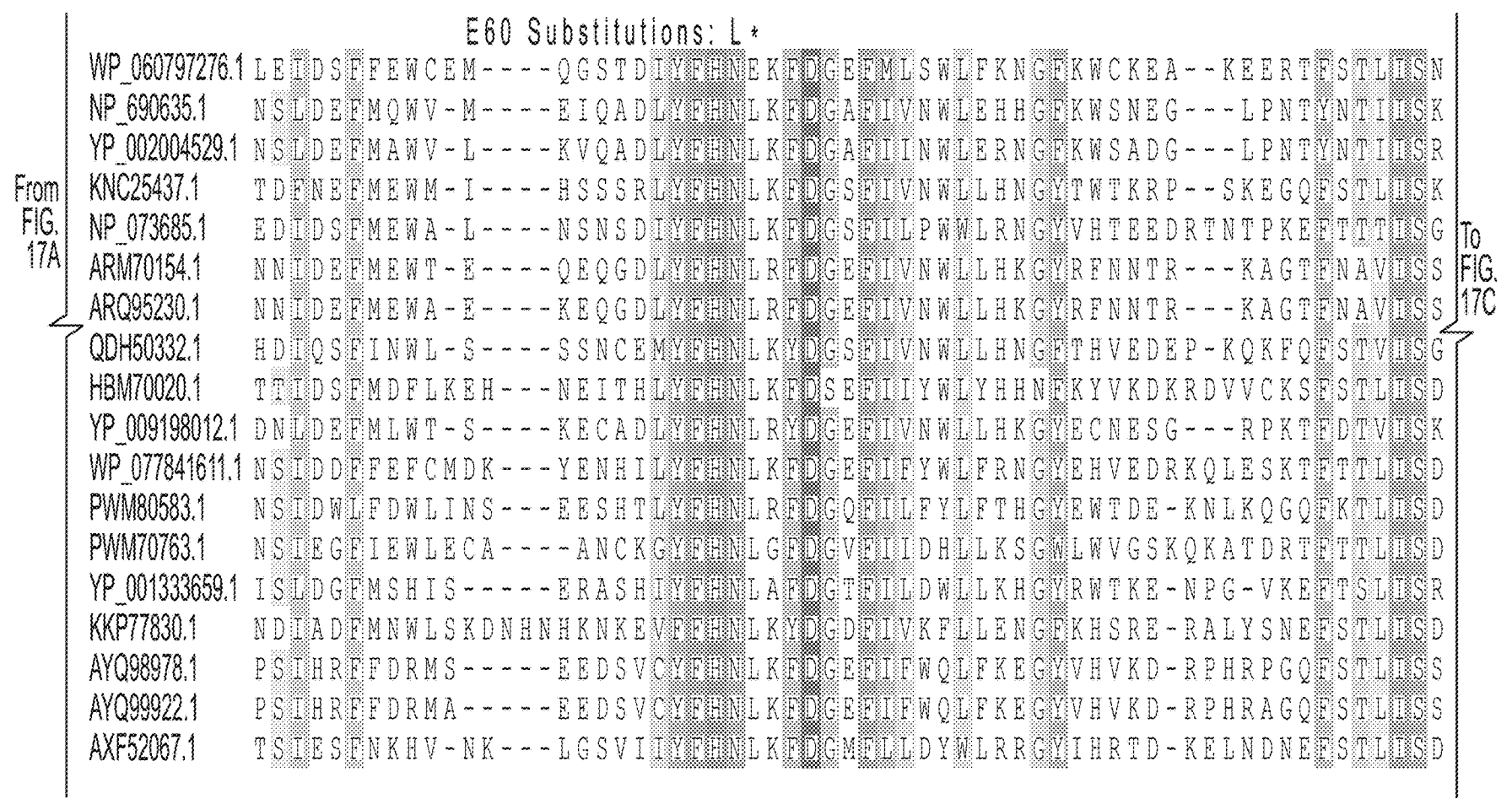
Figure 17C:
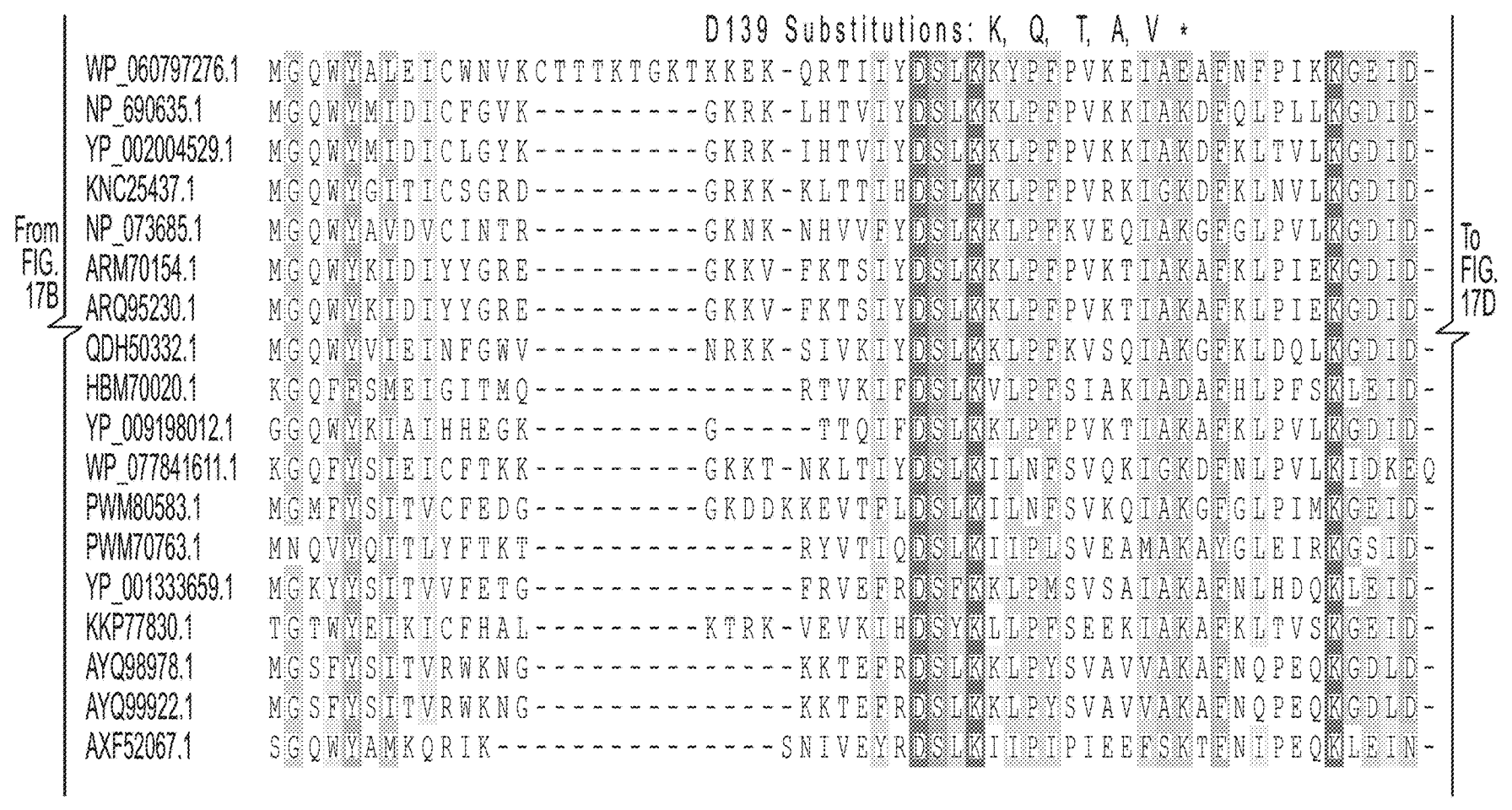
Figure 17D:
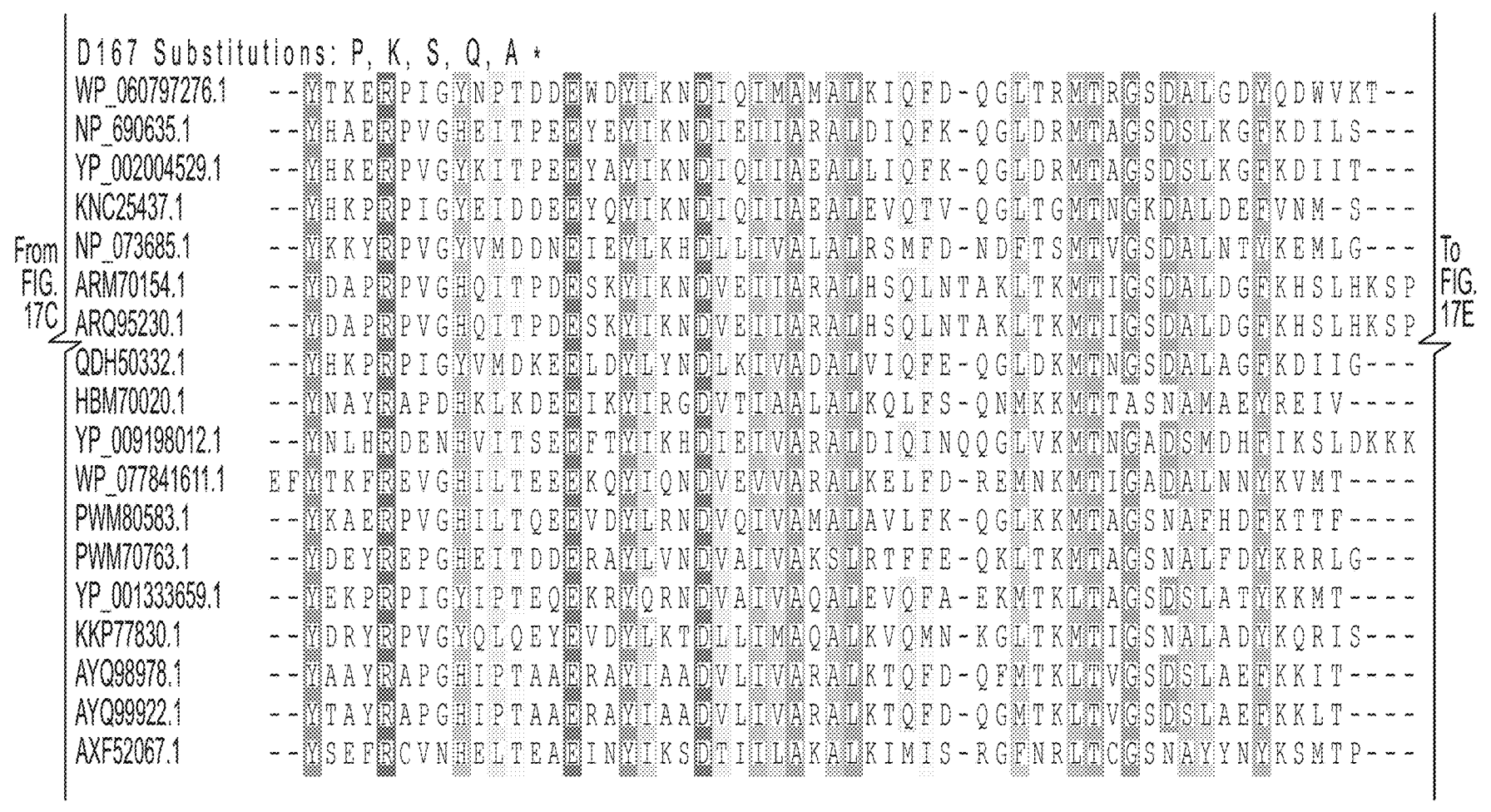
Figure 17E:
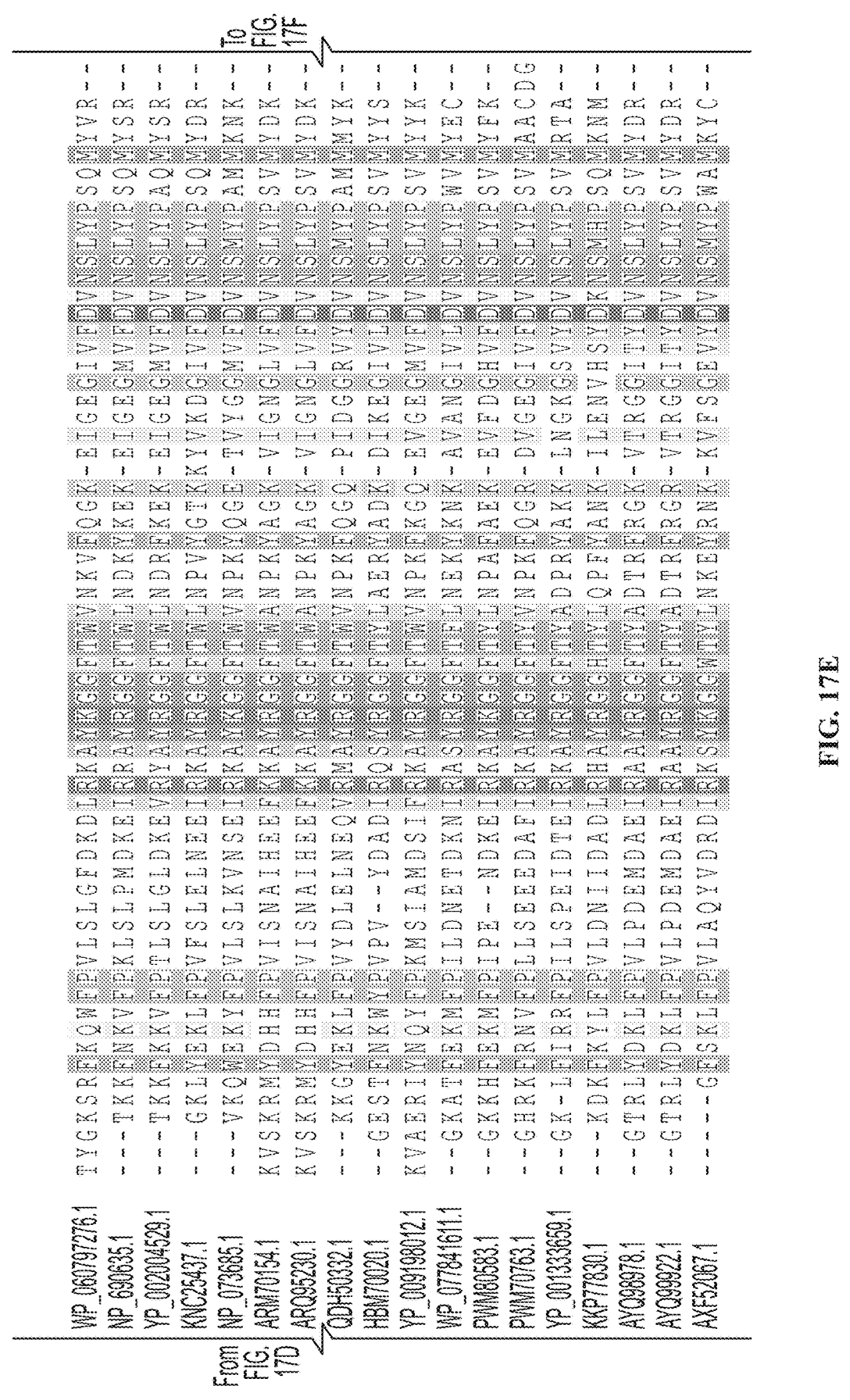
Figure 17F:
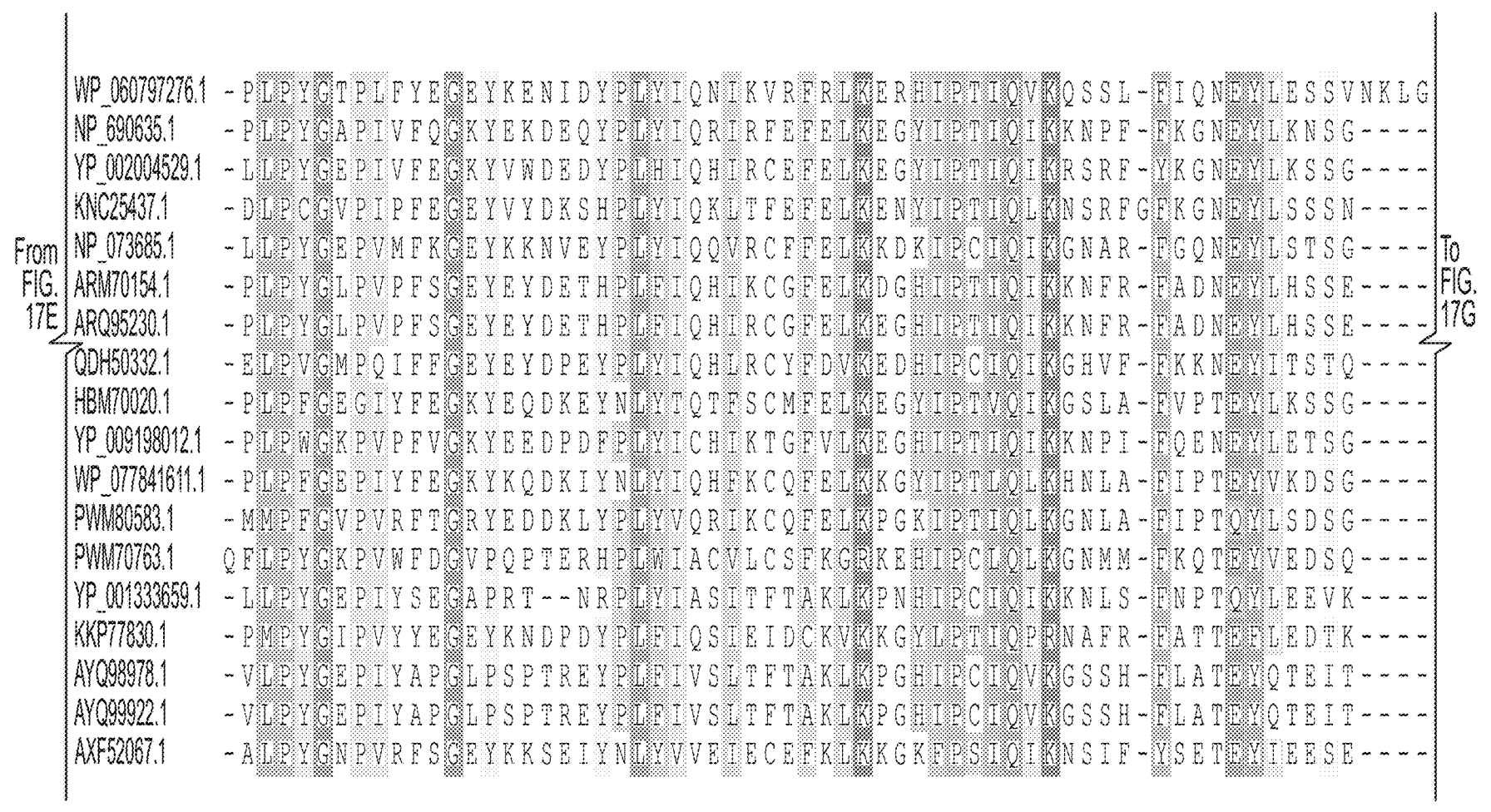
Figure 17G:
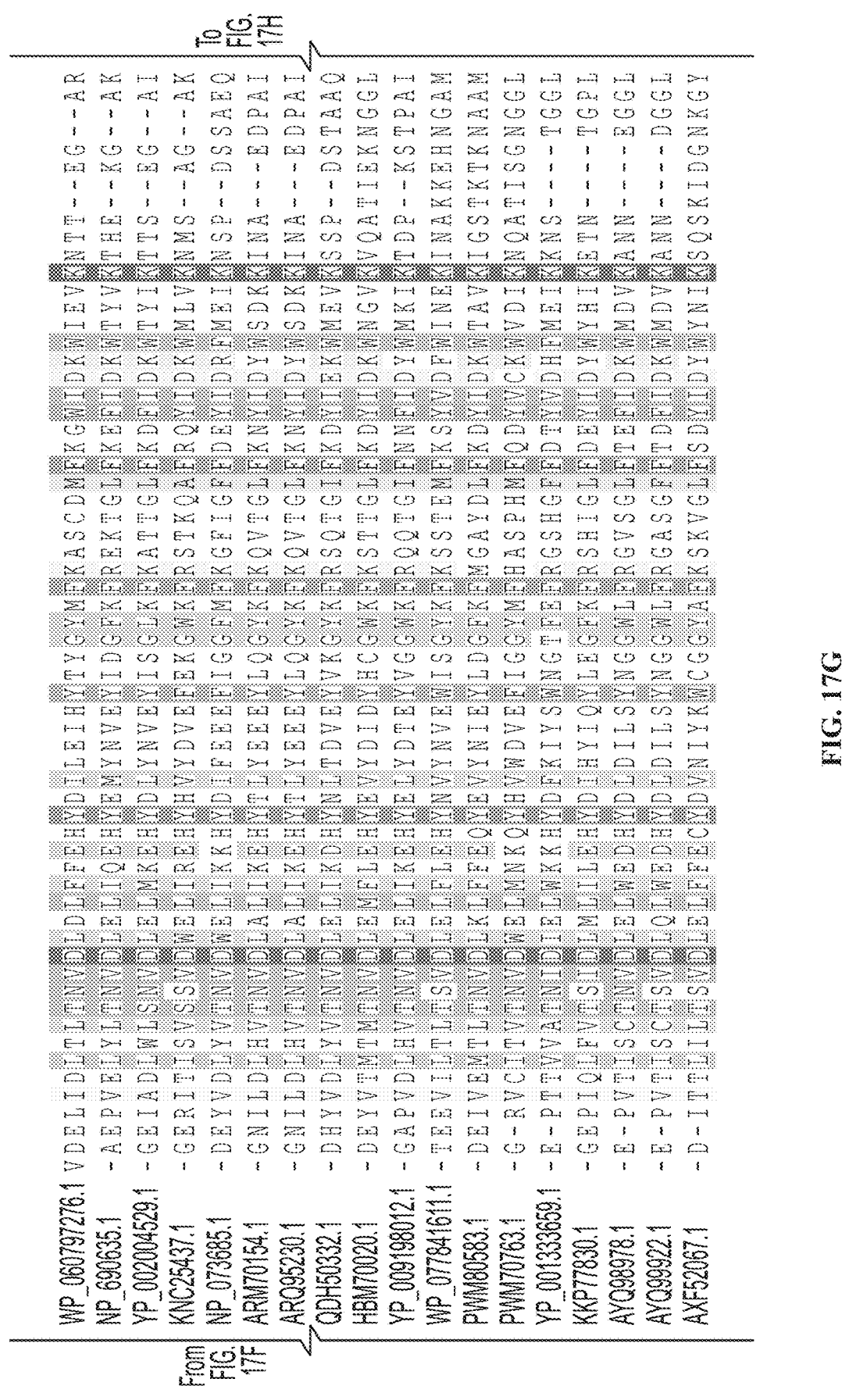
Figure 17H:
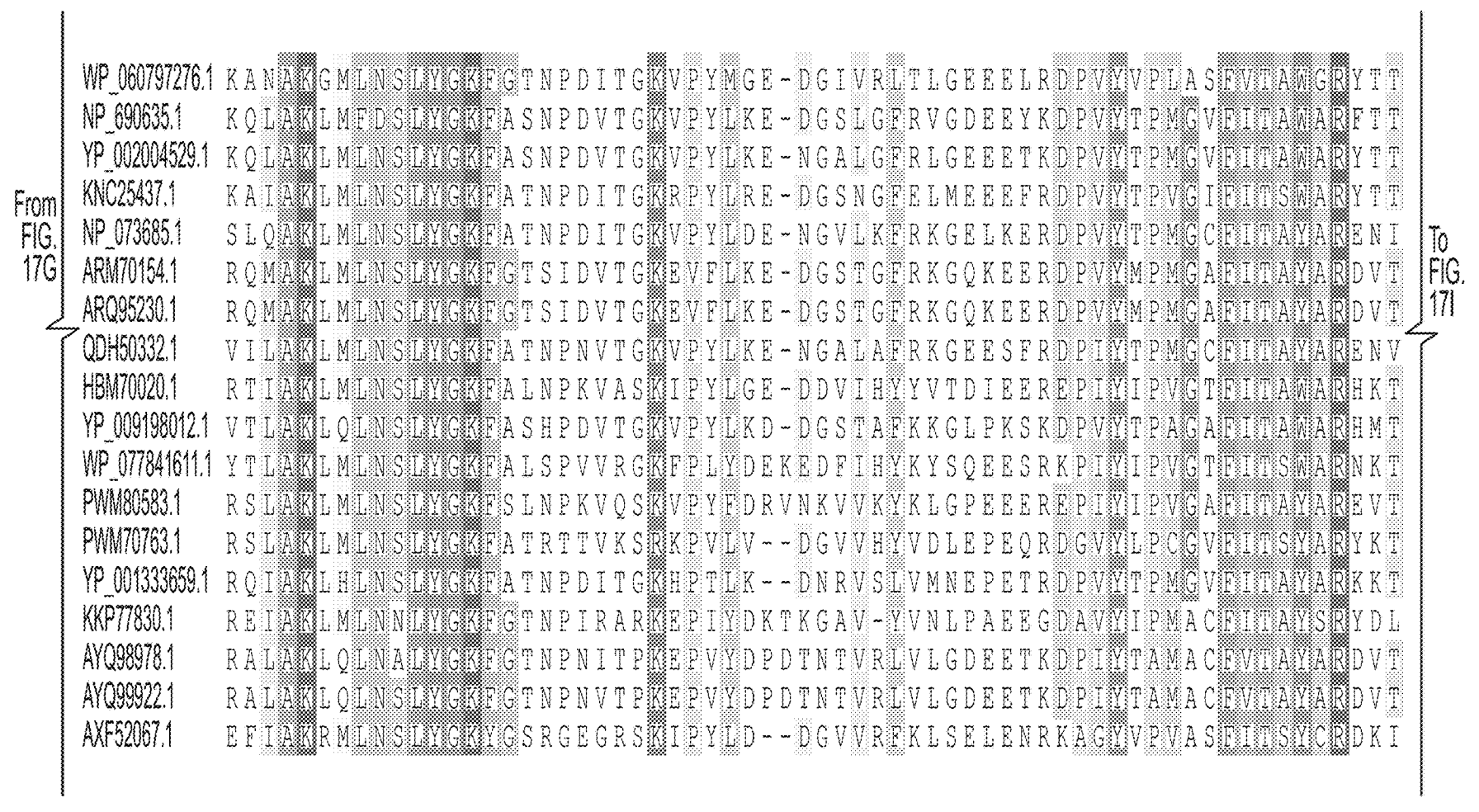
Figure 17I:
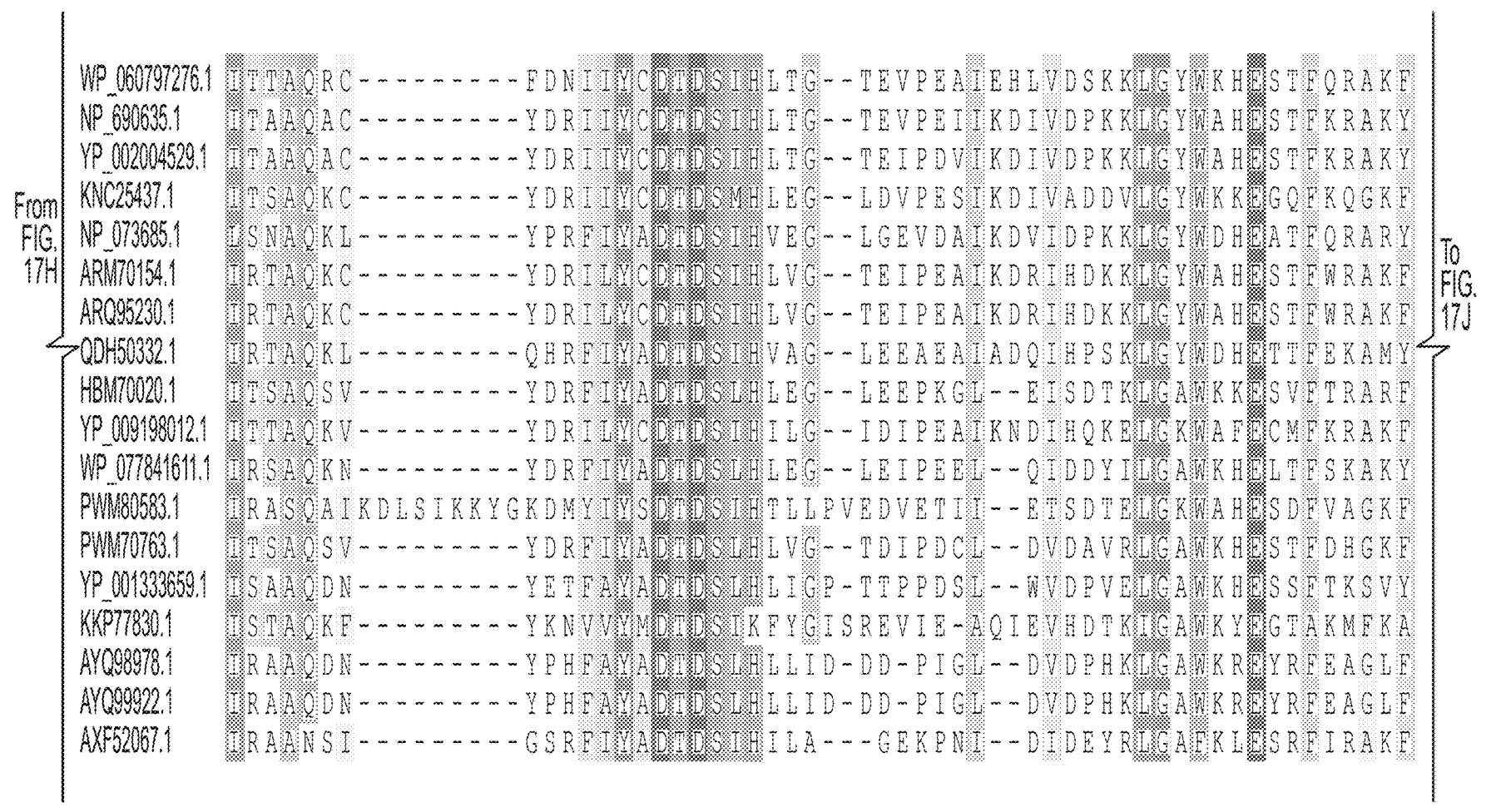
Figure 17J:
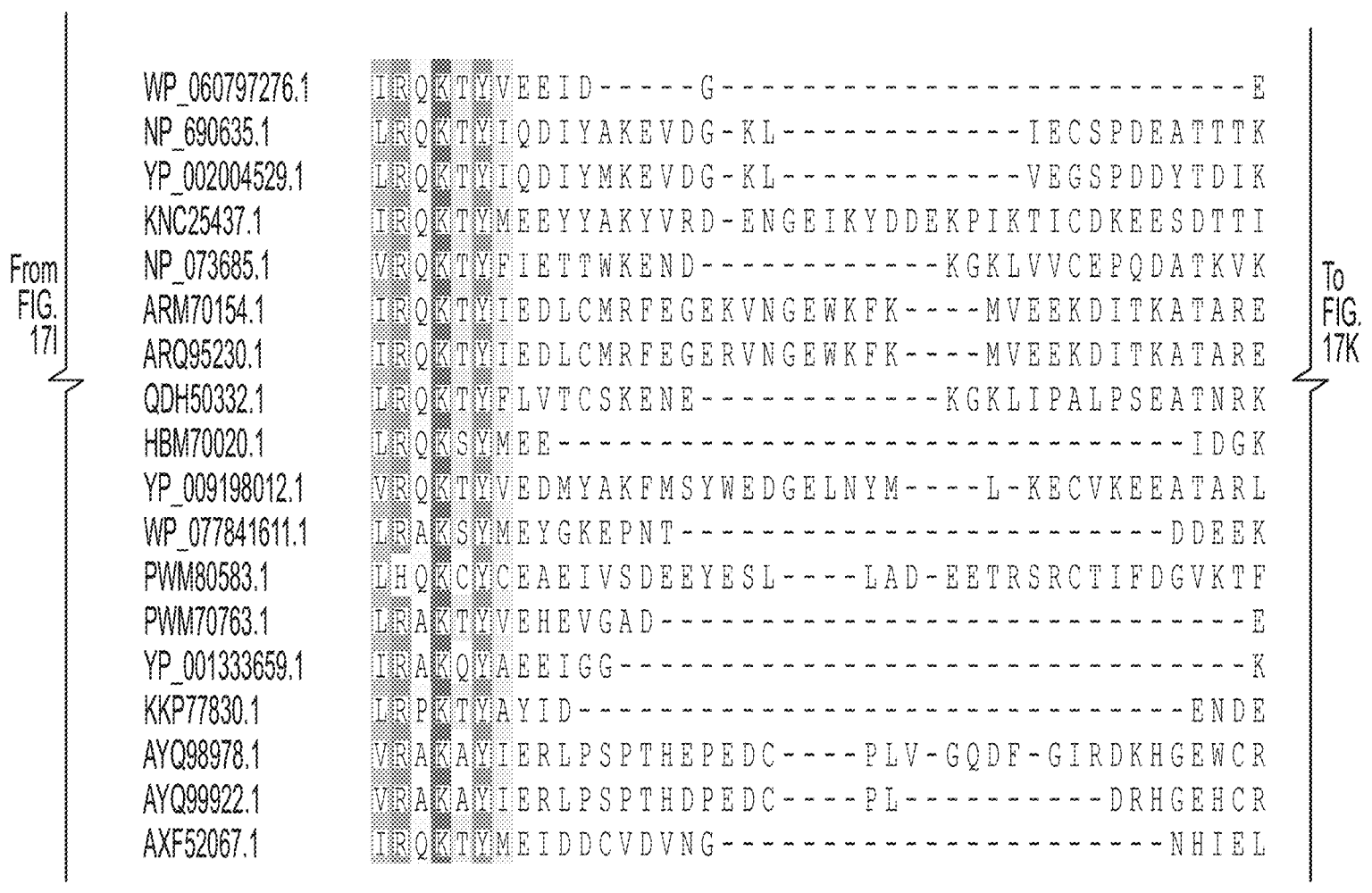
Figure 17K:
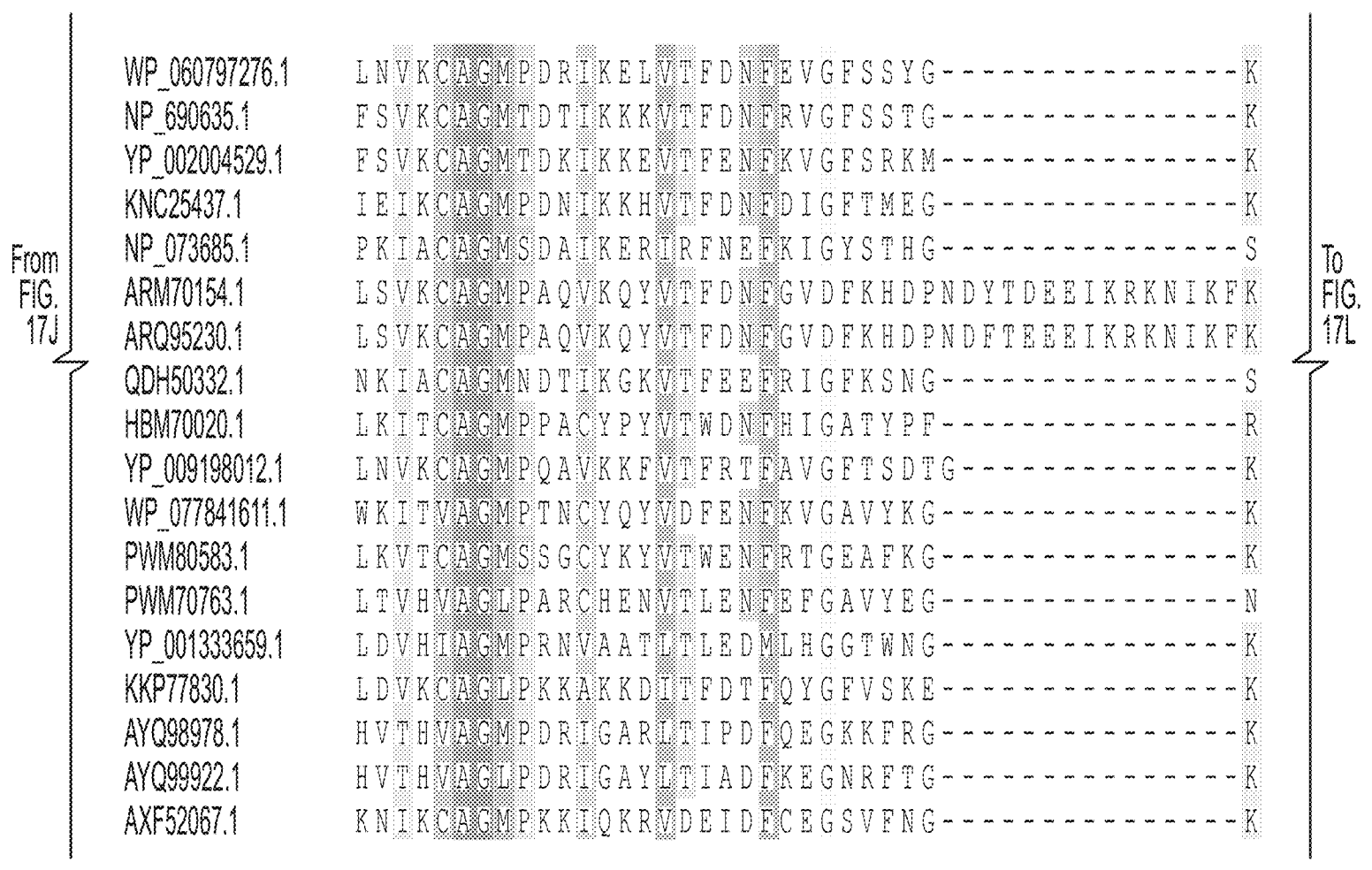

FIGS. 17A-17L show an amino acid sequence alignment of the sequence of *E. faecium* polymerase and seventeen homologous polymerase. Sequences from top to bottom are: WP 060797276.1 (SEQ ID NO: 2); NP 690635.1 (SEQ ID NO: 828); YP 002004529.1 (SEQ ID NO: 829); KNC25437.1 (SEQ ID NO: 830); NP 073685.1 (SEQ ID NO: 10); ARM70154.1 (SEQ ID NO: 22); ARQ95230.1 (SEQ ID NO: 831); QDH50332.1 (SEQ ID NO: 832); HMB70020.1 (SEQ ID NO: 833); YP 009198012.1 (SEQ ID NO: 9); WP 077841611.1 (SEQ ID NO: 834); PWM80583.1 (SEQ ID NO: 835); PWM70763.1 (SEQ ID NO: 836); YP 001333659.1 (SEQ ID NO: 11); KKP77830.1 (SEQ ID NO: 12); AYQ98978.1 (SEQ ID NO: 837); AYQ99922.1 (SEQ ID NO: 838); and AXF52067.1 (SEQ ID NO: 839). Various positions are highlighted (with asterisks), including E60 (substitution L), E139 (substitutions K, Q, T, A, V) and D167 (substitutions P, K, S, Q, A).

Figure 18:
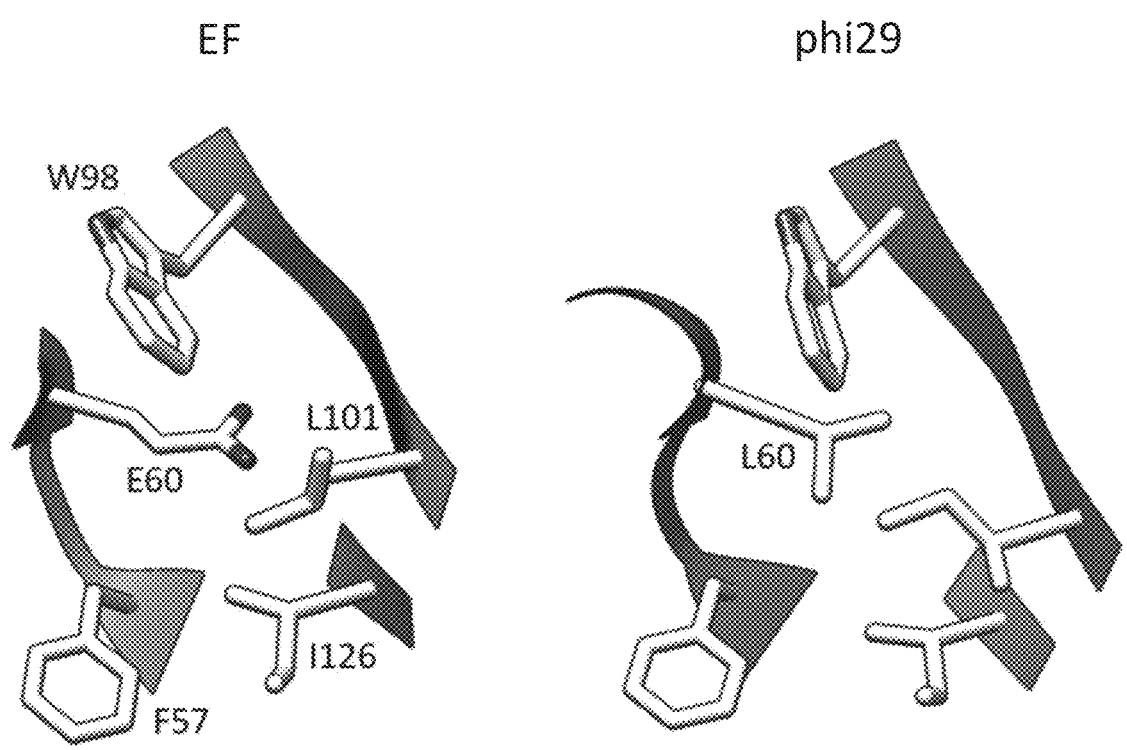

FIG. 18 shows the region surrounding residue 60 in an in-house crystal structure of wild-type *E. faecium* polymerase compared with the same region in Φ29 polymerase.

Figures 19, 20:
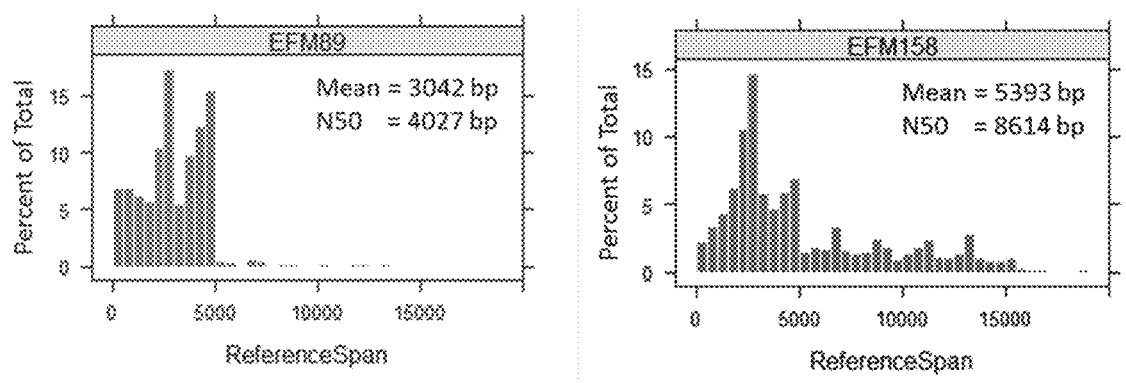

FIG. 19 shows results from DNA sequencing reactions with preparations of EFM89 and EFM158.

FIG. 20 shows read lengths achieved using EFM89 polymerase (left) and EFM158 polymerase (right).

Figure 21:
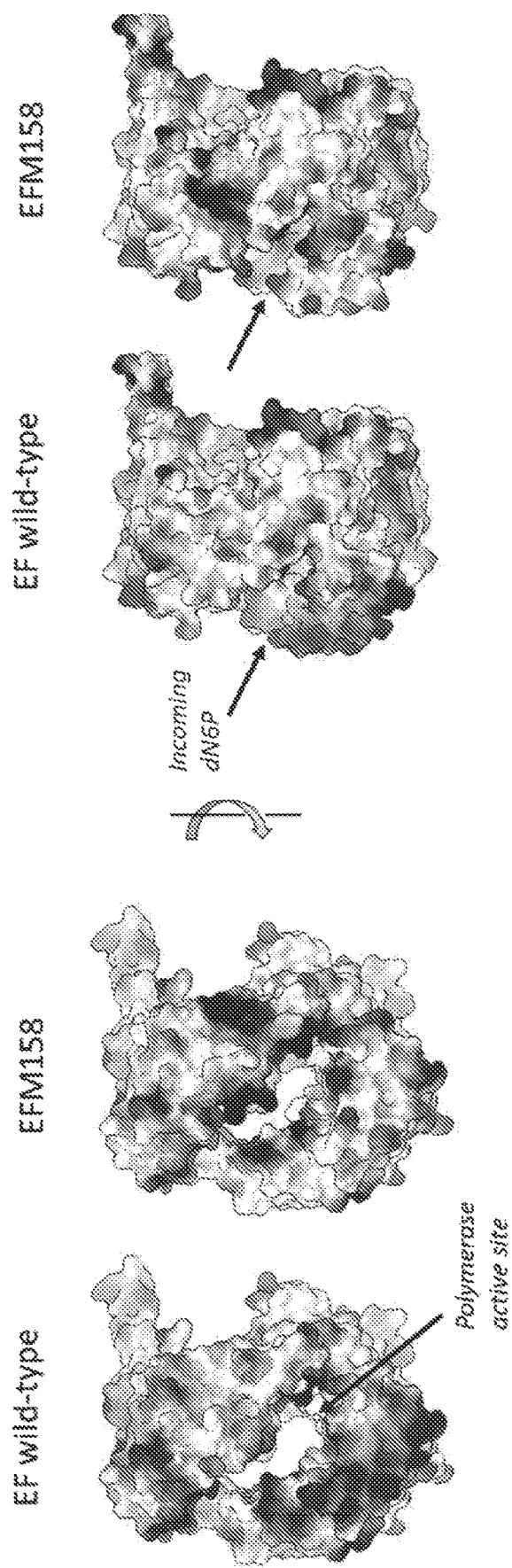

FIG. 21 shows crystal structure comparisons of wild-type *E. faecium* polymerase and EFM158, including a view of active site (left) and a view of the surface of the evolved variant (right).

FIGS. 22A-22C shows decreased interpulse duration with introduction of positively charged amino acids at positions 1148 (FIG. 22A), E482 (FIG. 22B) and D492 (FIG. 22C). Interpulse durations from single-molecule DNA sequencing are displayed for a pair of *E. faecium* polymerase variants that differ in sequence only at the position noted. Interpulse duration decreased by 21.3%, 5.8%, and 22.6% for 1148K, E482K, and D492H, respectively.

Figure 23:
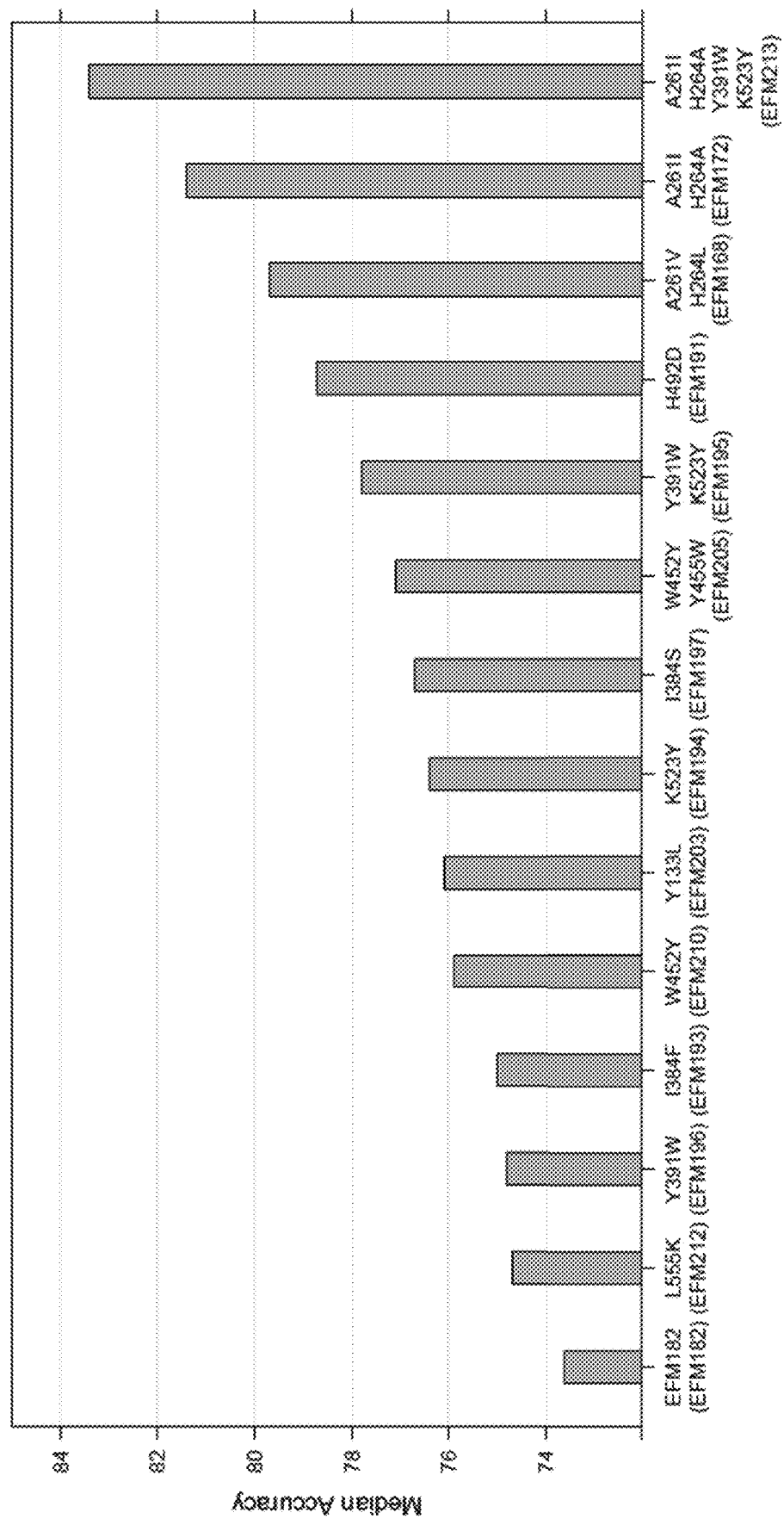

FIG. 23 shows single substitutions and combinations that improve alignment accuracy in single molecule DNA sequencing. Variant sequence identifiers are listed in parentheses. All variants have amino acid sequences that are equivalent to EFM182 except at the positions noted. Substitutions are written with respect to EFM182.

Figure 24:
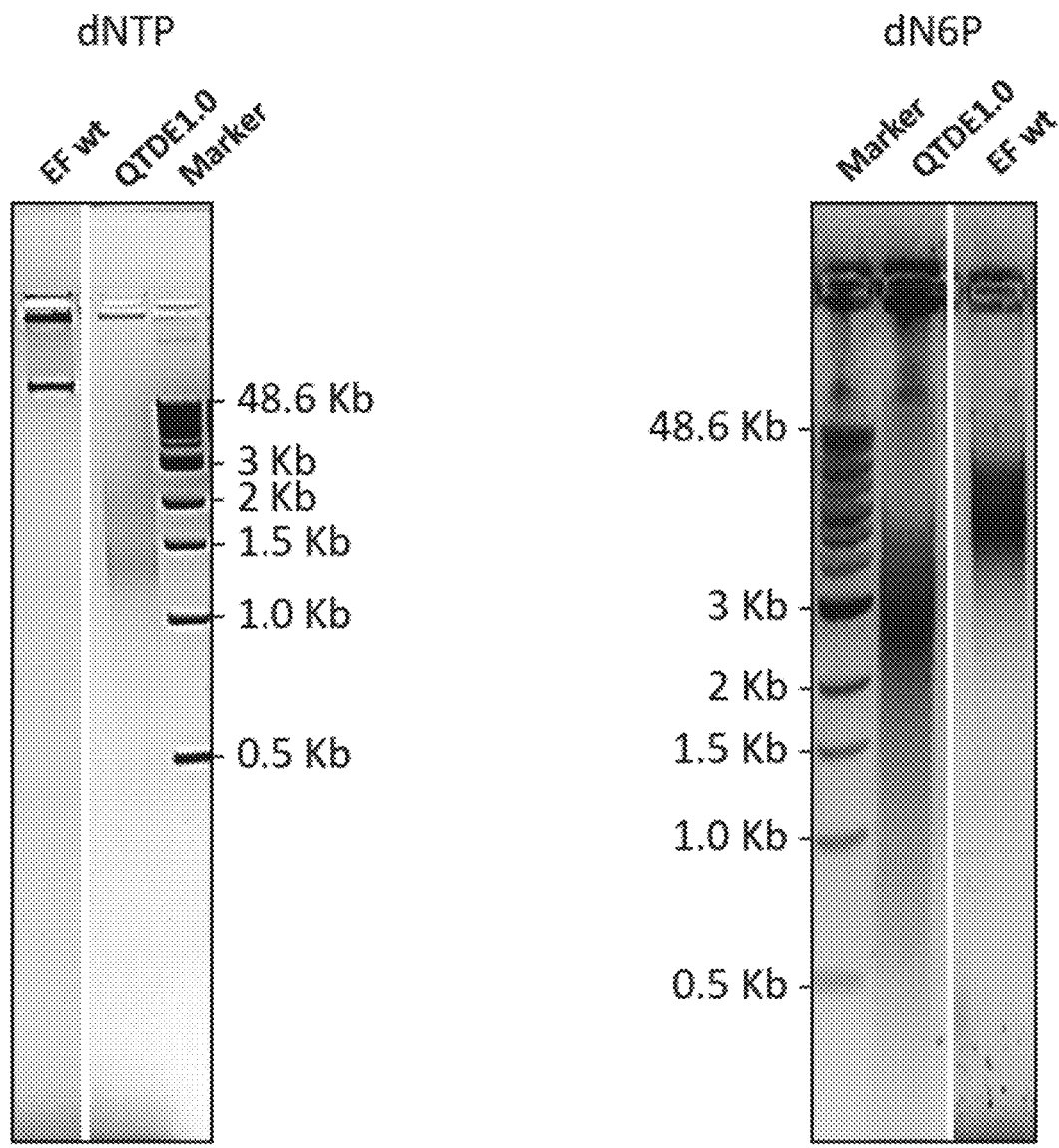

FIG. 24 shows results from rolling-circle assays assessing the processivity of wild-type EF polymerase carried out for 30 min at 30° C. with a 90-mer dumbbell DNA template with dNTPs (left) and dN6P analogs (right). Results with known processive polymerase QTDE1.0 are shown as a reference.

FIG. 25 shows substitutions enriched in an emulsion-based IVTT-RCA screen with *E. faecium* polymerase.

DETAILED DESCRIPTION

Aspects of the disclosure relate to modified polymerizing enzymes and compositions thereof. In some aspects, the disclosure provides methods of using modified recombinant polymerizing enzymes and compositions comprising the enzymes. In some embodiments, the disclosure provides modified recombinant polymerizing enzymes and compositions which may be used for conducting in vitro polymerization reactions. In some aspects, the polymerizing enzymes described herein are modified recombinant nucleic acid polymerases, e.g., modified recombinant DNA polymerases. In some embodiments, modified recombinant DNA polymerases provided by the disclosure may be used for in vitro reactions related to the manipulation of DNA (e.g., DNA sequencing).

I. Modified Polymerizing Enzymes

Among other aspects, the disclosure provides modified polymerizing enzymes (or modified polymerases) that may be used to conduct in vitro polymerization reactions. In some embodiments, polymerases described herein comprise one or more modifications which, individually or in combination, are useful to conduct a sequencing reaction. In some embodiments, one or more of the modifications described herein can be utilized to produce a polymerase having one or more properties useful for conducting sequencing reactions, e.g., properties such as polymerase processivity, fidelity (e.g., accuracy), substrate (e.g., nucleoside polyphosphate) binding affinity, substrate utilization (e.g., the rate at which nucleoside polyphosphates are incorporated into a growing strand complementary to a template strand), polymerase interactions with modified substrates (e.g., labeled nucleoside polyphosphates), or some combination thereof. In some embodiments, one or more of the modifications minimize or eliminate proofreading capability of the polymerase. For example, in some embodiments, one or more modifications may be made to an exonuclease domain of a polymerase that effects a loss in exonuclease activity of the polymerase.

The present application is based in part on the recognition by the inventors that certain modifications (e.g., mutations, insertions, and/or substitutions) to wild-type polymerases enhance functional attributes of said polymerases to provide improved reagents for nucleic acid manipulation applications. As such, in some aspects, the disclosure relates to modified polymerizing enzymes. The terms "polymerase" or "polymerizing enzyme" as used herein, generally refer to any enzyme capable of catalyzing a polymerization reaction. Examples of polymerases include, but are not limited to, a DNA polymerase, an RNA polymerase, a thermostable polymerase, a wild-type polymerase, a recombinant polymerizing enzyme, *Escherichia coli* DNA polymerase I, T7 DNA polymerase, bacteriophage T4 DNA polymerase (φ29 (phi29) DNA polymerase, Taq polymerase, Tth polymerase, Tli polymerase, Pfu polymerase, Pwo polymerase, VENT® polymerase, Deep VENT™ polymerase, Ex TAQ™ polymerase, LA TAQ™ polymerase, S so polymerase, Poc polymerase, Pab polymerase, Mth polymerase, ES4 polymerase, Tru polymerase, Tac polymerase, Tne polymerase, Tma polymerase, Tca polymerase, Tih polymerase, Tfi polymerase, PLATINUM® Taq polymerases, Tbr polymerase, Tfl polymerase, Tth polymerase, PFUTURBO® polymerase, PYROBEST™ polymerase, Pwo polymerase, KOD polymerase, B st polymerase, Sac polymerase, Klenow fragment, polymerase with 3' to 5' exonuclease activity, and variants, modified products and derivatives thereof. In some embodiments, the polymerase is a single subunit polymerase. Additional example of polymerases include M2Y polymerase, *Lucilia cuprina* polymerase, *Enterococcus faecium* polymerase, *Bacillus* phage VMY22 polymerase, *Bacillus* phage GA-1 polymerase, *Actinomyces* phage AV-1 polymerase, *Candidatus Moranbacteria* polymerase, *Bacillus* phage MG-B1 polymerase, *Eggerthella* sp. polymerase, *Streptococcus* phage CP-7 polymerase, *Bacteroides* sp. polymerase, *Chlamydia trachomatis* polymerase, and *Globodera pallida* polymerase. Further non-limiting examples of DNA polymerases include 9° NM™ DNA polymerase (New England Biolabs), and a P680G mutant of the Klenow exo-polymerase (Tuske et al. (2000) JBC 275(31):23759-23768). Non-limiting examples of DNA polymerases and their properties are described in detail in, among other places, DNA Replication 2nd edition, Kornberg and Baker, W. H. Freeman, New York, N.Y. (1991). Non-limiting examples of such sequences can be found in TABLE 1.

As described herein, polymerases and/or polymerase sequences are "homologous" when they are derived, naturally or artificially, from a common ancestral protein or amino acid sequence. Similarly, nucleic acids and/or nucleic acid sequences are homologous when they are derived, naturally or artificially, from a common ancestral nucleic acid or nucleic acid sequence. For example, any naturally occurring nucleic acid can be modified by any available mutagenesis method to include at least one specific codon that encodes for an amino acid that does not naturally occur at a given position in the polypeptide. When expressed, this mutagenized nucleic acid encodes a polypeptide comprising one or more mutated amino acids. In some embodiments, homology is generally inferred from sequence similarity between two or more nucleic acids or proteins (or sequences thereof). The precise percentage of similarity between sequences that is useful in establishing homology varies with the nucleic acid and protein at issue, but as little as 25% sequence similarity is routinely used to establish homology. Higher levels of sequence similarity, e.g., 30%, 40%, 50%, 60%, 70%, 80%, 90%, 95% or 99% or more can also be used to establish homology. Methods for determining sequence similarity percentages are well known to those having ordinary skill in the art. In some embodiments, similarity can be determined using algorithms such as those described herein, including for example BLASTP and BLASTN algorithms, for example, using default parameters.

TABLE 1

Exemplary Wild-Type Polymerase Amino Acid Sequences

| Name | SEQ ID NO. | Sequence |
|---|---|---|
| Φ29 | 1 | MKHMPRKMYSCDFETTTKVEDCRVWAYGYMNIEDHSEYKIGNSLDEFMAWVLKVQ ADLYFHNLKFDGAFIINWLERNGFKWSADGLPNTYNTIISRMGQWYMIDICLGYK GKRKIHTVIYDSLKKLPFPVKKIAKDFKLTVLKGDIDYHKERPVGYKITPEEYAY IKNDIQIIAEALLIQFKQGLDRMTAGSDSLKGFKDIITTKKFKKVFPTLSLGLDK EVRYAYRGGFTWLNDRFKEKEIGEGMVFDVNSLYPAQMYSRLLPYGEPIVFEGKY VWDEDYPLHIQHIRCEFELKEGYIPTIQIKRSRFYKGNEYLKSSGGEIADLWLSN VDLELMKEHYDLYNVEYISGLKFKATTGLFKDFIDKWTYIKTTSEGAIKQLAKLM LNSLYGKFASNPDVTGKVPYLKENGALGFRLGEEETKDPVYTPMGVFITAWARYT TITAAQACYDRIIYCDTDSIHLTGTEIPDVIKDIVDPKKLGYWAHESTFKRAKYL RQKTYIQDIYMKEVDGKLVEGSPDDYTDIKFSVKCAGMTDKIKKEVTFENFKVGF SRKMKPKPVQVPGGVVLVDDTFTIK |
| *Enterococcus faecium* (wild type) | 2 | MIKKYTGDFETTTDLNDCRVWSWGVCDIDNVDNITFGLEIDSFFEWCEMQGSTDI YFHNEKFDGEFMLSWLFKNGFKWCKEAKEERTFSTLISNMGQWYALEICWNVKCT TTKTGKTKKEKQRTIIYDSLKKYPFPVKEIAEAFNFPIKKGEIDYTKERPIGYNP TDDEWDYLKNDIQIMAMALKIQFDQGLTRMTRGSDALGDYQDWVKTTYGKSRFKQ WFPVLSLGFDKDLRKAYKGGFTWVNKVFQGKEIGEGIVFDVNSLYPSQMYVRPLP YGTPLFYEGEYKENIDYPLYIQNIKVRFRLKERHIPTIQVKQSSLFIQNEYLESS VNKLGVDELIDLTLTNVDLDLFFEHYDILEIHYTYGYMFKASCDMFKGWIDKWIE VKNTTEGARKANAKGMLNSLYGKFGTNPDITGKVPYMGEDGIVRLTLGEEELRDP VYVPLASFVTAWGRYTTITTAQRCFDNIIYCDTDSIHLTGTEVPEAIEHLVDSKK LGYWKHESTFQRAKFIRQKTYVEEIDGELNVKCAGMPDRIKELVTFDNFEVGFSS YGKLLPKRTQGGVVLVDTMFTIK |
| *Enterococcus faecium* (variant 1) | 3 | MMIKKYTGDFETTTDLNDCRVWSWGVCDIDNVDNITFGLDIDSFFEWCEMQGSTD IYFHNEKFDGEFMLSWLFKNGFKWSKETKEERTFSTLISNMGQWYALEICWEVNY ATTKSGKTKKEKVRTIIYDSLKKYPFPVKQIAEAFNFPIKKGEIDYTKERPVGYN PTDDEWDYLKNDIQIMAMALKIQFDQGLTRMTRGSDALGDYKDWLKATHGKSTFK QWFPILSLGFDKDLRKAYKGGFTWVNKVFQGKEIGDGIVFDVNSLYPSQMYVRPL PYGTPLFYEGEYKPNNDYPLYIQNIKVRFRLKEGYIPTIQVKQSSLFIQNEYLDS SVNKLGVDELIDLTLTNVDLELFFEHYDILEIHYTYGYMFKASCDMFKGWIDKWI EVKNTTEGARKANAKGMLNSLYGKFGTNPDITGKVPYMGEDGIVRLTLGEEELRD PVYVPLASFVTAWGRYTTITTAQRCFDRIIYCDTDSIHLVGTDVPEAIEHLVDPK KLGYWGHESTFQRAKFIRQKTYVEEIDGELNVKCAGMPDRIKELVTFDNFEVGFS SYGKLLPKRTQGGVVLVDTMFTIK |
| *Enterococcus faecium* (variant 2) | 4 | MMIKKYTGDFETTTDLNDCRVWSWGVCDIDNVDNITFGLDIDSFFEWCEMQGSTD IYFHNEKFDGEFMLSWLFKNGFKWSKETKEERTFSTLISNMGQWYALEICWEVNY ATTKSGKTKKEKVRTIIYDSLKKYPFPVKQIAEAFNFPIKKGEIDYTKERPVGYN PTDDEWEYLKNDIQIMAMALKIQFDQGLTRMTRGSDALGDYKDWLKATHGKSTFK QWFPILSLGFDKDLRKAYKGGFTWVNKVFQGKEIGDGIVFDVNSLYPSQMHVRPL PYGTPLFYEGEYKPNNDYPLYIQNIKVRFRLKEGYIPTIQVKQSSLFIQNEYLDS SVNKLGVDELIDLTLTNVDLELFFEHYDILEIHYTYGYMFKASCDMFKGWIDKWI |

TABLE 1-continued

Exemplary Wild-Type Polymerase Amino Acid Sequences

| Name | SEQ ID NO. | Sequence |
|---|---|---|
| | | EVKNTTEGARKANAKGMLNSLYGKFGTNPDITGKVPYMGEDGIVRLTLGEEELRD PVYVPLASFVTAWGRYTTITTAQRCFDRIIYCDTDSIHLVGTDVPEAIEHLVDPK KLGYWGHESTFQRAKFIRQKTYVEEIDGELNVKCAGMPDRIKELVTFDNFEVGFS SYGKLLPKRTQGGVVLVDTMFTIK |
| Enterococcus faecium (variant 3) | 5 | MIKKYTGDFETTTDLNDCRVWSWGVCDIDNVDNITFGLDIDSFFEWCEMQGSTDI YFHNEKFDGEFMLSWLFKNGFKWSKETKEERTFSTLISNMGQWYALEICWEVNYT TTKSGKTKKEKVRTIIYDSLKKYPFPVKQIAEAFNFPIKKGEIDYTKERPVGYNP TDDEWDYLKNDIQIMAMALKIQFDQGLTRMTRGSDALGDYKDWLKATHGKSTFKQ WFPILSLGFDKDLRKAYKGGFTWVNKVFQGKEIGDGIVFDVNSLYPSQMYVRPLP YGTPLFYEGEYKPNNDYPLYIQNIKVRFRLKEGYIPTIQVKQSSLFIQNEYLDSS VNKLGVDELIDLTLTNVDLELFFEHYDILEIHYTYGYMFKASCDMFKGWIDKWIE VKNTTEGARKANAKGMLNSLYGKFGTNPDITGKVPYMGEDGIVRLTLGEEELRDP VYVPLASFVTAWGRYTTITTAQRCFDRIIYCDTDSIHLVGTDVPEAIEHLVDPKK LGYWGHESTFQRAKFIRQKTYVEEIDGELNVKCAGMPDRIKELVTFDNFEVGFSS YGKLLPKRTQGGVVLVDTMFTIK |
| M2Y | 6 | MSRKMFSCDFETTTKLDDCRVWAYGYMEIGNLDNYKIGNSLDEFMQWVMEIQADL YFHDLKFDGAFIVNWLEQHGFKWSNEGLPNTYNTIISKMGQWYMIDICFGYKGKR KLHTVIYDSLKKLPFPVKKIAKDFQLPLLKGDIDYHTERPVGHEITPEEYEYIKN DIEIIARALDIQFKQGLDRMTAGSDSLKGFKDILSTKKFNKVFPKLSLPMDKEIR KAYRGGFTWLNDKYKEKEIGEGMVFDVNSLYPSQMYSRPLPYGAPIVFQGKYEKD EQYPLYIQRIRFEFELKEGYIPTIQIKKNPFFKGNEYLKNSGVEPVELYLTNVDL ELIQEHYELYNVEYIDGFKFREKTGLFKDFIDKWTYVKTHEEGAKKQLAKLMLNS LYGKFASNPDVTGKVPYLKDDGSLGFRVGDEEYKDPVYTPMGVFITAWARFTTIT AAQACYDRIIYCDTDSIHLTGTEVPEIIKDIVDPKKLGYWAHESTFKRAKYLRQK TYIQDIYVKEVDGKLKECSPDEATTTKFSVKCAGMDTIKKKVTFDNFAVGFSSM GKPKPVQVNGGVVLVDSVFTIK |
| Lucilia cuprina WT | 7 | MARKRPIRITKNDRAEYKRLSKNAKSKLNRTVKNYGIDLSNDVDIPKLSDFKTRK EFNDWKQKITSFTSRSNQEYQFRKNEYGVVASVKELNEIKRNTKKAQKIAKEKID KAMKLDFYVEGERQGKVKDRIKLMKKEEVAGVSVPVDFDFDKIQTRKRLEDKAGF MEERATGDYYRKKDIQMKENFISMIEQGFNSDADEVIKKLKKIPPDDFVELTIVT DEIDFRNYGSKNEGGINDEDKLEELNNTLNDYFNETTTDVNDCRVWAYGWMEIGK TSNYKIGTDFNEFMEWMIHSSSRLYFHNLKFDGSFIVNWLLHNGYTWTKRPSKEG QFSTLISKMGQWYGITICSGRDGRKKKLTTIHDSLKKLPFPVRKIGKDFKLNVLK GDIDYHKPRPIGYEIDDEEYQYIKNDIQIIAEALEVQTVQGLTGMTNGKDALDEF VNMSGKLYEKLFPVFSLELNEEIRKAYRGGFTWLNPVYGTKKYVKDGIVFDVNSL YPSQMYDRDLPCGVPIPFEGEYVYDKSHPLYIQKLTFEFELKENYIPTIQLKNSR FGFKGNEYLSSSNGERITISVSSVDWELIREHYHVYDVEFEKGWKFRSTKQAFRQ YIDKWMLVKNMSAGAKKAIAKLMLNSLYGKFATNPDITGKRPYLREDGSNGFELM EEEFRDPVYTPVGIFITSWARYTTITSAQKCYDRIIYCDTDSMHLEGLDVPESIK DIVADDVLGYWKKEGQFKQGKFIRQKTYMEEYYAKYVRDENGEIKYDDEKPIKTI CDKEESDTTIIEIKCAGMPDNIKKHVTFDNFDIGFTMEGKLKPKQVYGGVVLVEE TYTMK |
| Lucilia cuprina mod. | 8 | MKHMPRKMYSCDFETTTDVNDCRVWAYGWMEIGKTSNYKIGTDFNEFMEWMIHSS SRLYFHDLKFDGSFIVNWLLHNGYTWTKRPSKEGQFSTLISKMGQWYGITICSGR DGRKKKLTTIHDSLKKLPFPVRKIGKDFKLNVLKGDIDYHKPRPIGYEIDDEEYQ YIKNDIQIIAEALEVQTVQGLTGMTNGKDALDEFVNMSGKLYEKLFPVFSLELNE EIRKAYRGGFTWLNPVYGTKKYVKDGIVFDVNSLYPSQMYDRDLPCGVPIPFEGE YVYDKSHPLYIQKLTFEFELKENYIPTIQLKNSRFGFKGNEYLSSSNGERITISV SSVDWELIREHYHVYDVEFEKGWKFRSTKQAFRQYIDKWMLVKNMSAGAKKAIAK LMLNSLYGKFATNPDITGKRPYLREDGSNGFELMEEEFRDPVYTPVGIFITSWAR YTTITSAQKCYDRIIYCDTDSMHLEGLDVPESIKDIVADDVLGYWKKEGQFKQGK FIRQKTYMEEYYAKYVRDENGEIKYDDEKPIKTICDKEESDTTIIEIKCAGMPDN IKKHVTFDNFDIGFTMEGKLKPKQVYGGVVLVEETYTMK |
| Bacillus phage VMY22 | 9 | MATKKRKAYSCDFEATTSTYSETETRVWAYGWMEIGNTSHFNIGDNLDEFMLWTS KECADLYFHDLRYDGEFIVNWLLHKGYECNESGRPKTFDTVISKGGQWYKIAIHH EGKGTTQIFDSLKKLPFPVKTIAKAFKLPVLKGDIDYNLHRDENHVITSEEFTYI KHDIEIVARALDIQINQQGLVKMTNGADSMDHFIKSLDKKKKVAERIYNQYFPKM SIAMDSIFRKAYRGGFTWVNPKFKGQEVGEGMVFDVNSLYPSVMYYKPLPWGKPV PFVGKYEEDPDFPLYICHIKTGFVLKEGHIPTIQIKKNPIFQENEYLETSGGAPV DLHVTNVDLELIKEHYELYDTEYVGGWKFRQQTGIFNNFIDYWMKIKTDPKSTPA IVTLAKLQLNSLYGKFASHPDVTGKVPYLKDDGSTAFKKGLPKSKDPVYTPAGAF ITAWARHMTITTAQKVYDRILYCDTDSIHILGIDIPEAIKNDIHQKELGKWAFEC MFKRAKFVRQKTYVEDMYAKFMSYWEDGELNYMLKECVKEEATARLLNVKCAGMP QAVKKFVTFRTFAVGFTSDTGKLKPKHVKGGQILVDVPFTIK |
| Bacillus phage GA-1 | 10 | MARSVYVCDFETTTDPEDCRLWAWGWMDIYNTDKWSYGEDIDSFMEWALNSNSDI YFHNLKFDGSFILPWWLRNGYVHTEEDRTNTPKEFTTTISGMGQWYAVDVCINTR GKNKNHVVFYDSLKKLPFKVEQIAKGFGLPVLKGDIDYKKYRPVGYVMDDNEIEY LKHDLLIVALALRSMFDNDFTSMTVGSDALNTYKEMLGVKQWEKYFPVLSLKVNS |

TABLE 1-continued

Exemplary Wild-Type Polymerase Amino Acid Sequences

| Name | SEQ ID NO. | Sequence |
|---|---|---|
| | | EIRKAYKGGFTWVNPKYQGETVYGGMVFDVNSMYPAMMKNKLLPYGEPVMFKGEY KKNVEYPLYIQQVRCFFELKKDKIPCIQIKGNARFGQNEYLSTSGDEYVDLYVTN VDWELIKKHYDIFEEEFIGGFMFKGFIGFFDEYIDRFMEIKNSPDSSAEQSLQAK LMLNSLYGKFATNPDITGKVPYLDENGVLKFRKGELKERDPVYTPMGCFITAYAR ENILSNAQKLYPRFIYADTDSIHVEGLGEVDAIKDVIDPKKLGYWDHEATFQRAR YVRQKTYFIETTWKENDKGKLVVCEPQDATKVKPKIACAGMSDAIKERIRFNEFK IGYSTHGSLKPKNVLGGVVLMDYPFAIK |
| Actinomyces phage AV-1 | 11 | MVRQSTIASPARGGVRRSHKKVPSFCADFETTTDEDDCRVWSWGIIQVGKLQNYV DGISLDGFMSHISERASHIYFHNLAFDGTFILDWLLKHGYRWTKENPGVKEFTSL ISRMGKYYSITVVFETGFRVEFRDSFKKLPMSVSAIAKAFNLHDQKLEIDYEKPR PIGYIPTEQEKRYQRNDVAIVAQALEVQFAEKMTKLTAGSDSLATYKKMTGKLFI RRFPILSPEIDTEIRKAYRGGFTYADPRYAKKLNGKGSVYDVNSLYPSVMRTALL PYGEPIYSEGAPRTNRPLYIASITFTAKLKPNHIPCIQIKKNLSFNPTQYLEEVK EPTTVVATNIDIELWKKHYDFKIYSWNGTFEFRGSHGFFDTYVDHFMEIKKNSTG GLRQIAKLHLNSLYGKFATNPDITGKHPTLKDNRVSLVMNEPETRDPVYTPMGVF ITAYARKKTISAAQDNYETFAYADTDSLHLIGPTTPPDSLWVDPVELGAWKHESS FTKSVYIRAKQYAEEIGGKLDVHIAGMPRNVAATLTLEDMLHGGTWNGKLIPVRV PGGTVLKDTTFTLKID |
| Candidatus Moranbacteria | 12 | MKLKSKYVADFEATGEEQYKIDGSTHVWAVGVIDIETEETVLISNDIADFMNWLS KDNHNHKNKEVFFHNLKYDGDFIVKFLLENGFKHSRERALYSNEFSTLISDTGTW YEIKICFHALKTRKVEVKIHDSYKLLPFSEEKIAKAFKLTVSKGEIDYDRYRPVG YQLQEYEVDYLKTDLLIMAQALKVQMNKGLTKMTIGSNALADYKQRISKDKFKYL FPVLDNIIDADLRHAYRGGHTYLQPFYANKILENVHSYDKNSMHPSQMKNMPPMY GIPVYYEGEYKNDPDYPLFIQSIEIDCKVKKGYLPTIQPRNAFRFATTEFLEDTK GEPIQLFVTSIDLMLILEHYDIHYIQYLEGFKFRSHIGLFDEYIDYWYHIKETNT GPLREIAKLMLNNLYGKFGTNPIRARKEPIYDKTKGAVYVNLPAEEGDAVYIPMA CFITAYSRYDLISTAQKFYKNVVYMDTDSIKFYGISREVIEAQIEVHDTKIGAWK YEGTAKMFKALRPKTYAYIDENDELDVKCAGLPKKAKKDITFDTFQYGFVSKEKL EIKRVKGGTILLKTKFEIKKQVDNKHIDTEYFEDEDIDIFNQL |
| Bacillus phage MG-B1 | 13 | MKKKRTKTKIKTYACDFETNTEAWLHEDKLRDELKTKEENPELWRKREAWKLHTG GDKAFVWSWGGTEIREDMSFKGELDNFVVGKGISEYVDWMLDGSKNVWFHNLKFD GSFIAVELLRRGFKFTFDRNPAIGEFTGLIDGKKMWFELIICKEGKRGGRQFITI KDSLKKVPFGLRVAAMAFGLDVFKDDMDYDVIREPFEPIGEADYKYLKKDVEITA KIIHYQVFQSGLKKTTIGSDALNEFKSTVGGDKGFKEIFPVMDFDTDSFIRKSYF GGVTQVKPGMEGKLIGEGSVFDIVSMYPWVQYTKLLPYGLPIEYNGEYTYDEEYP LYVQQVSFSFVVKDNMLPTIQLKKQNVEFNYNEADDVRKFNGREFQKTSYGEIVT MYVTNVQWEQIQKHYWLDDLHFHKGMMFKGKIGLFKEHIDKWLKVKKQANDDGND ALKSLAKLMLNSPYGKFGTNTIRLNVEPPLWEDDESLGFRVEDDDPPPADPIYTA YASFVTAYAREELVSTIMMCYDRFVYCDTDSIHLIGTEIPEGIKHKIGGDLGDWE PESEFKLAKFHRAKTYCEMVYAKKVMKKDRWGDVVESLKHCSKEEWGTLPQDQKT LDKNLKCAGLQGHLKDYVSFEEFEIGLKINPEVNKDIMGKPLGKLMPCQVKGGTL LKVRKFSLN |
| Eggerthella sp. | 14 | MNEYISDFETQKDPDTGVMSVWAWSIVDVNDLSNIQYGNNIESWLSAIQGLPNGS LIGFHNLKFDGSYILSYLLGVAKWEYNYNDKPKARKAKTVECLISSIGVHYNYRINF TKRKYVKIYDTLKIFNMSVSQIAKSFGIKEQKGSIDYAIFRGYNYTMTPKEVEYI TNDVKIVAKAIKQFRNEGHERNTIASNAMRYYKKNSYYSNYEFLTYFPHLDDDLY HLLKRAYKGGYCYVNPKFKGKPVGHGRVYDVNSLYPSVMSDPQNKYPIGTPVFFE GKYKDDPIYPLYIQFITAQFELKKGKIPTIQIKNDKRFNPREYVTSTGCLMVNLY LTNVDLEMFYECYNIKEIQYIGGYKFIGRSGIFIDYVNHFKEMKMQATIEKNAGK RSIAKLFLNSLYGKFGASNDKFVKRPYINDKGILAYQTVETPRPAKTVYVPVAAF VTAYARRFIQTLFIKNVDRCCYCDTDSLHLIGDDPPEGVKISDTEFNCMAHESSF SRAKFLGAKLYIEEDEQGNLDVKAAGLGQNEVVKNQITFDNFNTEQEYFGILKSK TVQGGVELSESTFKIRERGTRF |
| Streptococcus phage CP-7 | 15 | MTCYYAGDFETTTNEEETEVWLSCFAKVIDYDKLDTFKVNTSLEDFLKSLYLDLD KTYTETGEDEFIIFFHNLKFDGSFLLSFPLNNDIECTYFINDMGVWYSITLEFPD FTLTFRDSLKILNFSIATMAGLFKMPIAKGTTPLLKHKPDEIKPEWIDYIHVDVA ILARGIFAMYYEENFSKYTSASEALTEFKRIFRKSKRKFRDFFPILDEKVDDFCR KAYRGGWTFANPKTQGRTLKQLIDIYDINSMYPATMLQNALPIGIPKRYKGKPKE IKEDHYYIYHIKADFDLKRGYLPTIQIKKKLDALRIGVRTSDYVTTSKNEVIDLY LTNFDLDLFLKHYDATIMYVETLEFQTESGLFDDYITTYRYKKENAQSPAEKQKA KIMLNSLYGKFGAKIISVKKLAYLDDKGILRFKNDDEEEVQPVYAPVALFVTSIA RHFIISNAQENYDNFLYADTDSLHLFHSDSLVLDIDPSEFGKWAHEGRAVKAKYL RSKLYIEELIQEDGTTHLDVKGAGMTPEIKEKITFENFVIGATFEGKRASKQIKG GTLIYETTFKIRETDYLV |
| Bacteroides sp. | 16 | MSKKSAKKPVIIAADFETTVYPGQTSTEVWSAAWIELFTERPHVRGNIEDFLNDI FNLNKNVLCYFHNLRFDGAFIVYWLLKNGYTWNNARNKGMNAKEFKALISDTNKW YTVTVKPKFDTVIEFRDSVKLMPMTLDQIGSAFNTKHRKLEMEYIGMRHANCEIT PEEYAYIINDIYVLKEALEVMIKSGHDKLTIGSCCMDEFKNKFDAMDFKAAFPNL |

TABLE 1-continued

Exemplary Wild-Type Polymerase Amino Acid Sequences

| Name | SEQ ID NO. | Sequence |
|---|---|---|
| | | KEIALIKYELGSDNVDQYIRKAYKGGYCYYKYKQRKHITQNGMTFDVNSLYPSVM<br>HSKSGNYYPTGKPIFFEKAIPYKCLEARVYPFYVRLRCRFKLKDGFLPTVQIKGD<br>YKYNSTQWLETSDIYYRGKYYRYFTNKEGQKEEARPELTLFMTDYLLLLEHYDVY<br>DLEILDGCYFHGAIGLFDTYIDHYMKIKMTTKDKGERTEAKLFLNNLYGRLAIND<br>NSSYREPFIDPETDSIGFELHPEHEKDTLYIAAGAAVTAYARYFTITHAQANYQN<br>FVYSDTDSIHMLDDGQPVKMIKEHATELLHWKRESDWSSAIFIRQKTYAEFVQKE<br>DGKKVTGHWEIKCAGMPEKSKKLFLASHPITDFKIGLKVGGKLKPKYISGGMVLV<br>EDFYTLRAKRC |
| Chlamydia trachomatis | 17 | MKARKFKIYAADFETTVFKGQTFTEVWSACFCELYKKDAKIMHSIQDFFNYFFSL<br>NENIKMYEHNLKEDGSFILSYLLKDLKYEQAYEKMNADGSLVRWLETKDMKNNSI<br>KYSISEMGQWYYIIIKKNNKIIEIRDSLKLLPFSLEAIGKSFDTEHKKLKMKYEG<br>YRYAGCEITPEEQAYIKNDVLVLKEALEIMFNEKHESLTIGSCCLNEYKTIMTKF<br>LIERLYPNIAEYTVNVPLEFKNADEYVRKSYKGGWCYLKKGCENKIYNNGTTADV<br>NSLYSSVMHSESGNYYPVGLPTEWSGNYIPEIAKEKYYFIRIKTRFYLKKRFLPC<br>IQVKNTYRYKSTEWLETSDFYDKKTNKYYKKYLDINGNEQNTQVILTLTMTDFEL<br>IKEHYNLVDFEILDGCYFDKEIGLFDEYINKYKKIKLNSKGAKKTLAKLYLNNLY<br>GKTATNTDSSFKVAYIKDDLSLGFYGVYACDKKPFYIPVGSAITSYARNFTIRAA<br>QKNYKNFIYADTDSIHCKCNPAEIKGITIDDKKELCWKLESCWDKGLEVRQKTYI<br>EHITAENLKPIDKPFYNVKCAGMPEQCKTLFLKSIGEDVDISDLNINDDAKEFLK<br>KKRTIKDFKAGLSVPLKLRPVQINGGVLLTETFYTM |
| Globodera pallida | 18 | MPLPRKKASSNGLSKRIYLADFETTTQAEDCRVWSWGLCSVENTENVEFGGDLDS<br>FIERISEENSITFFHNLKFDGAFILDRLFRLGYEFTDEKAPQVKEFSTLISKMGQ<br>FYSIKVRWENGMFTEFRDSLKKLPMSVKQVAKTFKLDQAKGEIDYHYLRPVGWVM<br>TPEEREYVKNDVQIVARALKVQLQEGMTRLTVGADSLAQYKSMMGKDFERHFPVL<br>TRTIDAEIRRAYRGGWAYADERHRGKVVGAGQTFDVNSLYPSVMYSKVLPYGEPV<br>FYPNGLPEVTEDHPLFITCITFTAKIRDGHLPCIQIKNSSLFTPTEYVKEVLDPI<br>TMYCTNVDLELWQEHYDMDILAYNGAWLFRGIRGFFNDYIDHWMRIKEESEGGRK<br>LIAKLHLNSLYGKFATNPDVTPKIPIFDEEKDIVRLIEGPPDERNPVYTAMGVFI<br>TSYARDLTIRTAQDHYDRFLYADTDSLHLLTSDGTNNGRKSKALEVHPSKLGYWK<br>HEYDFDAGLFVRAKAYTELMTGEFHVKSKCECDTPNDLHYQTHIAGMPEAIAQHI<br>TFESYRDGATFEGKLAPQRVPGGI |
| Potato cyst nematode | 19 | MPLPRKKASSNGLSKRIYLADFETTTQAEDCRVWSWGLCSVENTENVEFGGDLDS<br>FIERISEENSITFFHNLKFDGAFILDRLFRLGYEFTDEKAPQVKEFSTLISKMGQ<br>FYSIKVRWENGMFTEFRDSLKKLPMSVKQVAKTFKLDQAKGEIDYHYLRPVGWVM<br>TPEEREYVKNDVQIVARALKVQLQEGMTRLTVGADSLAQYKSMMGKDFERHFPVL<br>TRTIDAEIRRAYRGGWAYADERHRGKVVGAGQTFDVNSLYPSVMYSKVLPYGEPV<br>FYPNGLPEVTEDHPLFITCITFTAKIRDGHLPCIQIKNSSLFTPTEYVKEVLDPI<br>TMYCTNVDLELWQEHYDMDILAYNGAWLFRGIRGFFNDYIDHWMRIKEESEGGRK<br>LIAKLHLNSLYGKFATNPDVTPKIPIFDEEKDIVRLIEGPPDERNPVYTAMGVFI<br>TSYARDLTIRTAQDHYDRFLYADTDSLHLLTSDGTNNGRKSKALEVHPSKLGYWK<br>HEYDFDAGLFVRAKAYTELMTGEFHVKSKCECDTPNDLHYQTHIAGMPEAIAQHI<br>TFESYRDGATFEGKLAPQRVPGGIVLVDDTFTIK |
| Iberian lynx gut | 20 | MPSYTADFETTTVADDCRVWAWATSRIGNPDDVQLGNSIDTFLEWCRVHSGSRVY<br>FHNLKFDGKFILHKILTDGWKWIPDKNDCANRTFTTLISDMSQFYSIKLWFDESK<br>SIEFLDSLKVIPLPIAAIPKAFGLEIEKLDLDYQASREVGHELTEDEKEYIAHDV<br>KIAAMAMDTMFSQGMKKITAGSNAFADYKKTIGGKKRFRDWFPEPEYDEDLRKGG<br>CYKGGFTAVNPKIAGKKLGKGVSFDVNSLYPSVMASSHGEVLPYGEPIPYDGGYE<br>QDEDHPLYIQFIEADFAVKENRIPCLQLKGNVMFGETEYIRDSKGMQTLCLTSVD<br>MEMLFEHYXXXXXXXXXXXXXXXXXXXXXXXXXXXXXXXXXRTIAKLQLNSL<br>FAANPVKQSRMPYLDEGIVKYALLEPEHAEAQYLPAGAFITSYARQFTIRAAQAN<br>YERWLYCDTDSVYLRGTEPPVDMRVDAYELGAWKKEHEFDCFKAIRAKTYCFEED<br>GELTVHCAGMPARCHEHVTMDNFEVGASFPGKLKPKDVNGGTILVEDVFTIRP* |
| E. faecium (SK) | 21 | MIKKYTGDFETTTDLNDCRVWSWGVCDIDNVDNITFGLDIDSFFEWCEMQGSTDI<br>YFHNEKFDGEFMLSWLFKNGFKWSKETKEERTFSTLISNMGQWYALEICWEVNYT<br>TTKSGKTKKEKVRTIIYDSLKKYPFPVKQIAEAFNFPIKKGEIDYTKERPVGYNP<br>TDDEWDYLKNDIQIMAMALKIQFDQGLTRMTRGSDALGDYKDWLKATHGKSTFKQ<br>WFPILSLGFDKDLRKAYKGGFTWVNKVFQGKEIGDGIVFDVNSLYPSQMYVRPLP<br>YGTPLFYEGEYKPNNDYPLYIQNIKVRFRLKEGYIPTIQVKQSSLFIQNEYLDSS<br>VNKLGVDELIDLTLTNVDLELFFEHYDILEIHYTYGYMFKASCDMFKGWIDKWIE<br>VKNTTEGARKANAKGMLNSLYGKFGTNPDITGKVPYMGEDGIVRLTLGEEELRDP<br>VYVPLASFVTAWGRYTTITTAQRCFDRIIYCDTDSIHLVGTDVPEAIEHLVDPKK<br>LGYWGHESTFQRAKFIRQKTYVEEIDGELNVKCAGMPDRIKELVTFDNFEVGFSS<br>YGKLLPKRTQGGVVLVDTMFTIK |
| Bacillus phage Harambe | 22 | MGNKKRKIYSCDFETTTDVNDCRVWAYGLMEIDGKFENYKEGNNIDEFMEWTEQE<br>QGDLYFHNLRFDGEFIVNWLLHKGYRFNNTRKAGTFNAVISSMGQWYKIDIYYGR<br>EGKKVFKTSIYDSLKKLPFPVKTIAKAFKLPIEKGDIDYDAPRPVGHQITPDESK<br>YIKNDVEIIARALHSQLNTAKLTKMTIGSDALDGFKHSLHKSPKVSKRMYDHHPP<br>VISNAIHEEFKKAYRGGFTWANPKYAGKVIGNGLVFDVNSLYPSVMYDKPLPYGL |

TABLE 1-continued

Exemplary Wild-Type Polymerase Amino Acid Sequences

| Name | SEQ ID NO. | Sequence |
|---|---|---|
| | | PVPFSGEYEYDETHPLFIQHIKCGFELKDGHIPTIQIKKNFRFADNEYLHSSEGN<br>ILDLHVTNVDLALIKEHYTLYEEEYLQGYKFKQVTGLFKNYIDYWSDKKINAEDP<br>AIRQMAKLMLNSLYGKFGTSIDVTGKEVFLKEDGSTGFRKGQKEERDPVYMPMGA<br>FITAYARDVTIRTAQKCYDRILYCDTDSIHLVGTEIPEAIKDRIHDKKLGYWAHE<br>STFWRAKFIRQKTYIEDLCMRFEGEKVNGEWKFKMVEEKDITKATARELSVKCAG<br>MPAQVKQYVTFDNFGVDFKHDPNDYTDEEIKRKNIKFKLKPTHRKGGQVLVPTPF<br>TIK |
| Bacillus virus B103 | 23 | MPRKMFSCDFETTTKLDDCRVWAYGYMEIGNLDNYKIGNSLDEFMQWVMEIQADL<br>YFHNLKFDGAFIVNWLEHHGFKWSNEGLPNTYNTIISKMGQWYMIDICFGYKGKR<br>KLHTVIYDSLKKLPFPVKKIAKDFQLPLLKGDIDYHAERPVGHEITPEEYEYIKN<br>DIEIIARALDIQFKQGLDRMTAGSDSLKGFKDILSTKKFNKVFPKLSLPMDKEIR<br>RAYRGGFTWLNDKYKEKEIGEGMVFDVNSLYPSQMYSRPLPYGAPIVFQGKYEKD<br>EQYPLYIQRIRFEFELKEGYIPTIQIKKNPFFKGNEYLKNSGAEPVELYLTNVDL<br>ELIQEHYEMYNVEYIDGFKFREKTGLFKEFIDKWTYVKTHEKGAKKQLAKLMFDS<br>LYGKFASNPDVTGKVPYLKEDGSLGFRVGDEEYKDPVYTPMGVFITAWARFTTIT<br>AAQACYDRIIYCDTDSIHLTGTEVPEIIKDIVDPKKLGYWAHESTFKRAKYLRQK<br>TYIQDIYAKEVDGKLIECSPDEATTTKFSVKCAGMTDTIKKKVTFDNFRVGFSST<br>GKPKPVQVNGGVVLVDSVFTIK |
| Bacillus virus phi29 | 24 | MPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKR<br>KIHTVIYDSLKKLPFPVKKIAKDFKLTVLKGDIDYHKERPVGYKITPEGYIKTPN<br>DIQIIAEEALLIQFKQGLDRMTAGSDSLKGFKDIITTKKFKKVFPTLSLGLDKEVR<br>YAYRGGFTWLNDRFKEKEIGEGMVFDVNSLYPAQMYSRLLPYGEPIVFEGKYVWD<br>EDYPLHIQHIRCEFELKEGYIPTIQIKRSRFYKGNEYLKSSGGEIADLWLSNVDL<br>ELMKEHYDLYNVEYISGLKFKATTGLFKDFIDKWTYIKTTSEGAIKQLAKLMLNS<br>LYGKFASNPDVTGKVPYLKENGALGFRLGEEETKDPVYTPMGVFITAWARYTTIT<br>AAQACYDRIIYCDTDSIHLTGTEIPDVIKDIVDPKKLGYWAHESTFKRAKYLRQK<br>TYIQDIYMKEVDGKLVEGSPDDYTDIKFSVKCAGMTDKIKKEVTFENFKVGFSRK<br>MKPKPVQVPGGVVLVDDTFTIK |
| Bacillus phage (Beechbum) | 25 | MGNKKRKIYSCDFETTTDVNDCRVWAYGLMEIDGKFENYKEGNNIDEFMEWAEKE<br>QGDLYFHNLRFDGEFIVNWLLHKGYRFNNTRKAGTFNAVISSMGQWYKIDIYYGR<br>EGKKVFKTSIYDSLKKLPFPVKTIAKAFKLPIEKGDIDYDAPRPVGHQITPDESK<br>YIKNDVEIIARALHSQLNTAKLTKMTIGSDALDGFKHSLHKSPKVSKRMYDHHFP<br>VISNAIHEEFKKAYRGGFTWANPKYAGKVIGNGLVFDVNSLYPSVMYDKPLPYGL<br>PVPFSGEYEYDETHPLFIQHIRCGFELKEGHIPTIQIKKNFRFADNEYLHSSEGN<br>ILDLHVTNVDLALIKEHYTLYEEEYLQGYKFKQVTGLFKNYIDYWSDKKINAEDP<br>AIRQMAKLMLNSLYGKFGTSIDVTGKEVFLKEDGSTGFRKGQKEERDPVYMPMGA<br>FITAYARDVTIRTAQKCYDRILYCDTDSIHLVGTEIPEAIKDRIHDKKLGYWAHE<br>STFWRAKFIRQKTYIEDLCMRFEGERVNGEWKFKMVEEKDITKATARELSVKCAG<br>MPAQVKQYVTFDNFGVDFKHDPNDFTEEEIKRKNIKFKLKPTHRKGGQVLVPTPF<br>TIK |
| Bacillus phage (Karezi) | 26 | MSRNRPVYVADFEATTDPNDCRVWAWGVMDIYNQENWTYDHDIQSFINWLSSSNC<br>EMYFHNLKYDGSFIVNWLLHNGFTHVEDEPKQKFQFSTVISGMGQWYVIEINFGW<br>VNRKKSIVKIYDSLKKLPFKVSQIAKGFKLDQLKGDIDYHKPRPIGYVMDKEELD<br>YLYNDLKIVADALVIQFEQGLDKMTNGSDALAGFKDIIGKKGYEKLFPVYDLELN<br>EQVRMAYRGGFTWVNPKFQGQPIDGGRVYDVNSMYPAMMMYKELPVGMPQIFFGE<br>YEYDPEYPLYIQHLRCYFDVKEDHIPCIQIKGHVFFKKNEYITSTQDHYVDLYVT<br>NVDLELIKDHYNLTDVEYVKGYKFRSQTGIFKDYIEKWMEVKSSPDSTAAQVILA<br>KLMLNSLYGKFATNPNVTGKVPYLKENGALAFRKGEESFRDPIYTPMGCFITAYA<br>RENVIRTAQKLQHRFIYADTDSIHVAGLEEAEAIADQIHPSKLGYWDHETTFEKA<br>MYLRQKTYFLVTCSKENEKGKLIPALPSEATNRKNKIACAGMNDTIKGKVTFEEF<br>RIGFKSNGSLKPKQVFGGVVLMDQPFEIK |
| HBM70020.1 | 27 | MRFTADFETTTDPNDCRVWAWGLCLIDDIDIFYYGTTIDSFMDPFLKEHNEITHLY<br>FHNLKFDSEFIIYWLYHHNFKYVKDRDVVCKSFSTLISDKGQFFSMEIGITMQR<br>TVKIFDSLKVLPFSIAKIADAFHLPFSKLEIDYNAYRAPDHKLKDEEIKYIRGDV<br>TIAALALKQLFSQNMKKMTTASNAMAEYREIVGESTFNKWYPVPVYDADIRQSYR<br>GGFTYLAERYADKDIKEGIVLDVNSLYPSVMYYSPLPFGEGIYFEGKYEQDKEYN<br>LYTQTFSCMFELKEGYIPTVQIKGSLAFVPTEYLKSSGDEYVTMTMTNVDLEMPL<br>EHYEVYDIDYHCGWKFKSTTGLFKDYIDKWNGVKVQATIEKNGGLRTIAKLMLNS<br>LYGKFALNPKVASKIPYLGEDDVIHYYVTDIEEREPIYIPVGTFITAWARHKTIT<br>SAQSVYDRFIYADTDSLHLEGLEEPKGLEISDTKLGAWKKESVFTRARFLRQKSY<br>MEEIDGKLKITCAGMPPACYPYVTWDNFHIGATYPFRLRPMHTQGGIVLVNAPFT<br>IRK |
| Clostridium betjerinckii | 28 | MIATADFETTTLENDCRVWAYAICEIGNYDNFICONSIDDFFEFCMDKYENHILY<br>FHNLKFDGEFIFYWLFRNGYEHVEDRKQLESKTFTTLISDKGQFYSIEICFTKKG<br>KKTNKLTIYDSLKILNFSVQKIGKDFNLPVLKIDKEQEFYTKFREVGHILTEEEK<br>QYIQNDVEVVARALKELFDREMNKMTIGADALNNYKVMTGKATFEKMFPILDNET<br>DKNIRASYRGGFTFLNEKYKNKAVANGIVLDVNSLYPWVMYECPLPFGEPIYFEG |

TABLE 1-continued

Exemplary Wild-Type Polymerase Amino Acid Sequences

| Name | SEQ ID NO. | Sequence |
|---|---|---|
| | | KYKQDKIYNLYIQHFKCQFELKKGYIPTLQLKHNLAFIPTEYVKDSGTEEVILTL<br>TSVDLELFLEHYNVYNVEWISGYKFKSSTEMFKSYVDFWINEKINAKKEHNGAMY<br>TLAKLMLNSLYGKFALSPVVRGKFPLYDEKEDFIHYKYSQEESRKPIYIPVGTFI<br>TSWARNKTIRSAQKNYDRFIYADTDSLHLEGLEIPEELQIDDYILGAWKHELTFS<br>KAKYLRAKSYMEYGKEPNTDDEEKWKITVAGMPTNCYQYVDFENFKVGAVYKGKL<br>QHHRVSGGVILKETEFTIKM |
| *Succinivibrio* sp. (DBY31_076 15) | 29 | MILTADFETTTEAPARVWAIGLCEIANPDIFIYGNSIDWLFDWLINSEESHTLYF<br>HNLRFDGQFILFYLFTHGYEWTDEKNLKQGQFKTLISDMGMFYSITVCFEDGGKD<br>DKKEVTFLDSLKILNFSVKQIAKGFGLPIMKGEIDYKAERPVGHILTQEEVDYLR<br>NDVQIVAMALAVLFKQGLKKMTAGSNAFHDFKTTFGKKHFEKMFPIPENDKEIRK<br>AYKGGFTYLNPAFAEKEVFDGHVFDVNSLYPSVMYFKMMPFGVPVRFTGRYEDDK<br>LYPLYVQRIKCQFELKPGKIPTTQLKONLAFIPTQYLSDSGDEIVEMTLTNVDLK<br>LFFEQYEVYNIEYLDGFKFMGAYDLFKDYIDKWTAVKIGSTKTKNAAMRSLAKLM<br>LNSLYGKFSLNPKVQSKVPYFDRVNKVVKYKLGPEEEREPIYIPVGAFITAYARE<br>VTIRASQAIKDLSIKKYGKDMYIYSDTDSIHTLLPVEDVETIIETSDTELGKWAH<br>ESDFVAGKFLHQKCYCEAEIVSDEEYESLLADEETRSRCTIFDGVKTFLKVTCAG<br>MSSGCYKYVTWENFRTGEAFKGKLLHNNVEGGAILKEVDFTIK |
| *Firmicutes bacterium* (DBX59_101 40) | 30 | MRSYTFDFETTTDPEDCRVWAYGIYSIDDDRYITDGNSIEGFIEWLECAANCKGY<br>FHNLGFDGVFIIDHLLKSGWLWVGSKQKATDRTFTTLISDMNQVYQITLYFTKTR<br>YVTIQDSLKIIPLSVEAMAKAYGLEIRKGSIDYDEYREPGHEITDDERAYLVNDV<br>AIVAKSLRTFFEQKLTKMTAGSNALFDYKRRLGGHRKFRNVFPLLSEEEDAFIRK<br>AYRGGFTYVNPKFQGRDVGEGIVFDVNSLYPSVMAACDGQFLPYGKPVWFDGVPQ<br>PTERHPLWIACVLCSFKGRKEHIPCLQLKGNMMFKQTEYVEDSQGRVCITVTNVD<br>WELMNKQYHVWDVEFIGGYMFHASPHMFQDYVCKWVDIKNQATISGNGGLRSLAK<br>LMLNSLYGKFATRTTVKSRKPVLVDGVVHYVDLEPEQRDGVYLPCGVFITSYARY<br>KTITSAQSVYDRFIYADTDSLHLVGTDIPDCLDVDAVRLGAWKHESTFDHGKFLR<br>AKTYVEHEVGADELTVHVAGLPARCHENVTLENFEFGAVYEGNLTARKVPGGVVL<br>YEGTKEIRS |
| *Arthrobacter* phage Anjali | 31 | MRFIPAFLARFVGAIMGGRKQAQYVADFETTTDPDDCRVWAYGLANINTADSLWD<br>VEIGPSIHRFFDRMSEEDSVCYFHNLKFDGEFIFWQLFKEGYVHVKDRPHRPGQF<br>STLISSMGSFYSITVRWKNGKKTEFRDSLKKLPYSVAVVAKAFNQPEQKGDLDYA<br>AYRAPGHIPTAAERAYIAADVLIVARALKTQFDQGMTKLTVGSDSLAEFKKITGT<br>RLYDKLFPVLPDEMDAEIRAAYRGGFTYADTRFRGKVTRGGITYDVNSLYPSVMY<br>DRVLPYGEPIYAPGLPSPTREYPLFIVSLTFTAKLKPGHIPCIQVKGSSHFLATE<br>YQTEITEPVTISCTNVDLELWEDHYDLDILSYNGGWLFRGVSGLFTEFIDKWMDV<br>KANNEGGLRALAKLQLNALYGKFGTNPNITPKEPVYDPDTNTVRLVLGDEETKDP<br>IYTAMACFVTAYARDVTIRAAQDNYPHFAYADTDSLHLLIDDDPIGLDVDPHKLG<br>AWKREYRFEAGLFVRAKAYIERLPSPTHEPEDCPLVGQDFGIRDKHGEWCRHVTH<br>VAGMPDRIGARLTIPDFQEGKKFRGKLQPKRVPGGIVLEDIGFTLKMS |
| *Arthrobacter* phage Mendel | 32 | MRFIPAFLARFVGAIMGGRKQAQYVADFETTTDPDDCRVWAYGLANINTADSLWD<br>VEIGPSIHRFFDRMAEEDSVCYFHNLKFDGEFIFWQLFKEGYVHVKDRPHRAGQF<br>STLISSMGSFYSITVRWKNGKKTEFRDSLKKLPYSVAVVAKAFNQPEQKGDLDYT<br>AYRAPGHIPTAAERAYIAADVLIVARALKTQFDQGMTKLTVGSDSLAEFKKLTGT<br>RLYDKLFPVLPDEMDAEIRAAYRGGFTYADTRFRGRVTRGGITYDVNSLYPSVMY<br>DRVLPYGEPIYAPGLPSPTREYPLFIVSLTFTAKLKPGHIPCIQVKGSSHFLATE<br>YQTEITEPVTISCTSVDLQLWEDHYDLDILSYNGGWLFRGASGFFTDFIDKWMDV<br>KANNDGGLRALAKLQLNSLYGKFGTNPNVTPKEPVYDPDTNTVRLVLGDEETKDP<br>IYTAMACFVTAYARDVTIRAAQDNYPHFAYADTDSLHLLIDDDPIGLDVDPHKLG<br>AWKREYRFEAGLFVRAKAYIERLPSPTHDPEDCPLDRHGEHCRHVTHVAGLPDRI<br>GAYLTIADFKEGNRFTGKLQPKRVPGGIVLEDVGFTMKMS |
| *Podoviridae* sp. | 33 | MKDSYIYAADFETTTDASDCRVWAWCCTNINEPDNCTIGTSIESFNKHVNKLGSV<br>IIYFHNLKFDGMFLLDYWLRRGYIHRTDKELNDNEFSTLISDSGQWYAMKQRIKS<br>NIVEYRDSLKIIPIPIEEFSKTFNIPEQKLEINYSEFRCVNHELTEAEINYIKSD<br>TIILAKALKIMISRGFNRLTCGSNAYYNYKSMTPGFSKLFPVLAQYVDRDIRKSY<br>KGGWTYLNKEYRNKKVFSGEVYDVNSMYPWAMKYCALPYGNPVRFSGEYKKSEIY<br>NLYVVEIECEFKLKKGKFPSIQIKNSIFYSETEYIEESEDITTLILTSVDLELFF<br>ECYDVNIYKWCGGYAFKSKVGLFSDYIDYWYNIKSQSKIDGNKGYEFIAKRMLNS<br>LYGKYGSRGEGRSKIPYLDDGVVRFKLSELENRKAGYVPVASFITSYCRDKIIRA<br>ANSIGSRFIYADTDSIHILAGEKPNIDIDEYRLGAFKLESRFIRAKFIRQKTYME<br>IDDCVDVNGNHIELKNIKCAGMPKKIQKRVDEIDFCEGSVFNGKLLPEVVPGGVI<br>LKETTFEIKGSKKS |

*Sequence information unknown due to incomplete sequence coverage of gene in metagenomic shotgun sequencing Polymerases have various characteristics, including processivity. Polymerase processivity generally refers to the capability of a polymerase to consecutively incorporate dNTPs into a nucleic acid template without releasing the nucleic acid template. Upon base pairing between a nucleobase of a target nucleic acid and the complementary dNTP, the polymerase incorporates the dNTP into the newly synthesized nucleic acid strand by forming a phosphodiester bond between the 3' hydroxyl end of the newly synthesized strand and the alpha phosphate of the dNTP. Processivity is measured by the average number of nucleotides incorporated by a polymerase on a single association/disassociation event.

The processivity of polymerases vary. For example, a polymerase may exhibit high processivity relative to another polymerase. Alternatively, a polymerase may exhibit reduced processivity relative to another polymerase. Similarly, a polymerase may exhibit high processivity in a first condition (e.g., comprising a first combination of nucleotides) and reduced processivity in a second condition (e.g., comprising a second combination of nucleotides).

Additional characteristics of polymerases include, but are not limited to, synthesis accuracy, nuclease activity, nucleotide substrate utilization, nucleic acid affinity, replication capacity, average read length production, surface charge, and stability. Similar to processivity, these characteristics vary between polymerases and between reaction conditions.

The characteristics of a polymerase may be altered by the introduction of modifications (or changes) in the amino acid sequence of the polymerase. For example, in some embodiments, the processivity of a polymerase is increased (or, alternatively decreased) by modification. In some embodiments, the nuclease activity of a polymerase is increased (or, alternatively decreased) by modification. In some embodiments, the nucleotide substrate utilization (of one or more substrates) of a polymerase is increased (or, alternatively decreased) by modification. In some embodiments, the affinity of a polymerase toward one more substrates is increased (or, alternatively decreased) by modification. In some embodiments, the replication capacity of a polymerase is increased (or, alternatively decreased) by modification. In some embodiments, the average read length of a polymerase is increased (or, alternatively decreased) by modification. In some embodiments, the surface charge of a polymerase is made more positive (or, alternatively more negative) by modification. In some embodiments, the stability of a polymerase is increased (or, alternatively decreased) by modification. In some embodiments, one or more characteristics of a polymerase (e.g., processivity, nuclease activity, nucleotide substrate utilization, affinity toward one or more substrates, replication capacity, average read length, surface charge, stability, etc.) are increased by about 5%-10%, 10%-20%, 20%-30%, 30%-40%, 40%-50%, 50%-60%, 60%-70%, 70%-80%, 80%-90%, 90%-100%, or more. In some embodiments, one or more characteristics of a polymerase (e.g., processivity, nuclease activity, nucleotide substrate utilization, affinity toward one or more substrates, replication capacity, average read length, surface charge, stability, etc.) are increased by more than about 5%, by more than about 10%, by more than about 20%, by more than about 30%, by more than about 40%, by more than about 50%, by more than about 60%, by more than about 70%, by more than about 80%, by more than about 90%, by more than about 100%, or more. In some embodiments, one or more characteristics of a polymerase (e.g., processivity, nuclease activity, nucleotide substrate utilization, affinity toward one or more substrates, replication capacity, average read length, surface charge, stability, etc.) are decreased by about 5%-10%, 10%-20%, 20%-30%, 30%-40%, 40%-50%, 50%-60%, 60%-70%, 70%-80%, 80%-90%, 90%-100%, or more. In some embodiments, one or more characteristics of a polymerase (e.g., processivity, nuclease activity, nucleotide substrate utilization, affinity toward one or more substrates, replication capacity, average read length, surface charge, stability, etc.) are decreased by more than about 5%, by more than about 10%, by more than about 20%, by more than about 30%, by more than about 40%, by more than about 50%, by more than about 60%, by more than about 70%, by more than about 80%, or by more than about 90%. In some embodiments, one or more characteristics may be eliminated.

When a modification is introduced into the amino acid sequence of a polymerase, a "modified polymerase" (also referred to herein as a "modified polymerizing enzyme" or, when produced recombinantly, a "modified recombinant polymerase") is produced. A modification may comprise a deletion of one or more amino acids, an addition of one or more amino acids, a substitution of one or more amino acids, or a combination thereof. A modified polymerase may include one or more modifications (e.g., a deletion of one or more amino acids, an addition of one or more amino acids, a substitution of one or more amino acids as described in this application, or a combination thereof) relative to a wild-type polymerase (e.g., a sequence of Table 1, e.g., SEQ ID NO: 1, SEQ ID Nos: 2-5, SEQ ID Nos: 6-22, or SEQ ID Nos: 23-33), or relative to a sequence described in any of Tables 2-7. For example in some embodiments, a modification comprises a deletion, addition, or substitution of at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 41, at least 42, at least 43, at least 44, at least 45, at least 46, at least 47, at least 48, at least 49, at least 50, at least 55, at least 60, at least 70, at least 75, at least 80, at least 85, at least 90, at least 95, at least 100, at least 110, at least 120, at least 130, at least 140, or at least 150 amino acids (which may or may not be consecutive amino acids). In some embodiments, a modification comprises a deletion, addition, or substitution of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 105, 110, 115, 120, 125, 130, 140, or 150 amino acids (which may or may not be consecutive amino acids).

In some embodiments, a modified polymerase comprises one or more unnatural amino acid substitutions. As used herein, an "unnatural amino acid" refers to any amino acid, modified amino acid, or amino acid analogue other than the following twenty genetically encoded alpha-amino acids: alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, valine. In some embodiments, unnatural amino acids may include naturally occurring compounds other than the twenty alpha-amino acids above. Unnatural amino acids and methods of incorporating unnatural amino acids into protein sequences are known in the art, for example, as described in U.S. Pat. No. 7,045,337, the contents of which are incorporated herein by reference.

A. Amino Acid Modification Designations

A modification may be designated by a position within an amino acid sequence. For example, a modification may be designated "A484," indicating that the alanine residue at position 484 in the amino acid sequence of the polymerase has been modified (thereby producing the modified polymerase). Modifications may also be designated by the position/identity of a corresponding amino acid of a reference polymerase.

For example, in some embodiments, a modified polymerase comprises a mutation at a position corresponding to A484 in Φ29 polymerase (SEQ ID NO: 1). An amino acid corresponding to A484 in other polymerases can be determined by any method known in the art, including homology alignment. See e.g., FIG. 5B and FIGS. 17A-17K.

As a non-limiting example of this analysis, a homology alignment was conducted with a number of the polymerases reported in TABLE 1, and it was determined that A484 in Φ29 polymerase corresponds to A481 in M2Y, A492 in Bacillus phage VMY22, K500 in Enterococcus faecium, and K827 in Lucilia cuprina. Accordingly, homology alignments and similar methods known in the art may be used to identify amino acids in other polymerases corresponding to the positions of the modified residues described herein. Thus, it should be appreciated that the modifications of the disclosure are not intended to be limited to the polymerases described herein (e.g., those listed in TABLE 1) and can be extended to any polymerizing enzyme using known techniques.

In some embodiments, the sequence of a polymerase that is modified does not comprise one or more amino acids (i.e., one or more "homologous amino acids") that correspond to a position in a reference polymerase (e.g., a polymerase listed in TABLE 1). As such, in some embodiments, a polymerase is modified by addition (or insertion) of a homologous amino acid at the designated reference position, which is inferred based on the surrounding homologous residues of the polymerase that is modified. Mutated polymerase variants comprising homologous amino acids were engineered in accordance with embodiments described herein and are listed in TABLE 3.

(i) Amino Acid Modifications in Reference to *E. faecium* polymerase.

In some embodiments, an amino acid modification is made to a polymerase (e.g., a polymerase listed in TABLE 1), wherein the amino acid modification is made in reference to *E. faecium* polymerase (SEQ ID NOs: 2-5). For example, in some embodiments, a modified polymerase comprises an amino acid modification (i.e., mutation) at one or more positions (e.g., at 1-117 positions or any whole number between, for example 2 or more, 5 or more, 10 or more, 15 or more, 20 or more, for example all—and in any combination, thereof) corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, and T571 in *E. faecium* polymerase (SEQ ID NO: 2).

Such a modification may comprise a deletion (e.g., a deletion of an amino acid at a position corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, or T571 (or any combination thereof) in *E. faecium* polymerase (SEQ ID NO: 2)).

Alternatively, or in addition, such a modification may comprise an addition (e.g., an addition of a homologous amino acid at a position corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, or T571 (or any combination thereof) in *E. faecium* polymerase (SEQ ID NO: 2)).

Alternatively, or in addition, such a modification may comprise a substitution. For example, a modification may comprise a substitution at one or more positions (e.g., at 1-117 positions or any whole number between, for example 2 or more, 5 or more, 10 or more, 15 or more, 20 or more, for example all—and in any combination, thereof) corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, and T571 in *E. faecium* polymerase (SEQ ID NO: 2). In some embodiments, a substitution is selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, N145H, N145R, P147Q, P147T, I148K, I148H, I148R, E152D, I153V, P160A, D167P, D167K, D167H, D167R, D171K, D171H, D171R, N175T, N175Y, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, P273S, P273R, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, D374Q, D374H, I384T, I384F, I384S, E385Y, E385K, E385R, E385N, E385Q, E385L, E385A, N388T, E391Y, E391W, E391F, E391H, E391M, E391K, E391R, A396Q, N397L, G400L, D414V, D425N, R429G, E436R, E436G, L437Y, L437E, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S502A, S503T, Q506K, Q513D, D521K, D521R, D521H, E523R, E523V, E523Y, E523F, E523H, E523W, V526L, D533A, D533Q, D533T, D533R, D533S, R534K, E537K, E537H, E537R, E545K, E545H, E545R, G547S, L555K, L555R, P556A, R558H, T559V, V564L, T568D, T568S, M569K, M569T, M569V, and T571S (corresponding to positions in *E. faecium* polymerase (SEQ ID NO: 2)).

Exemplary modification combinations are listed in TABLE 7.

(ii) Amino Acid Modifications in Reference to Φ29 polymerase.

In some embodiments, an amino acid modification is made to a polymerase (e.g., a polymerase listed in TABLE 1), wherein the amino acid modification is made in reference to 129 polymerase (SEQ ID NO: 1). For example, in some embodiments, a modified polymerase comprises an amino acid modification (i.e., mutation) at one or more positions (e.g., 2 or more, 5 or more, 10 or more, 15 or more, 20 or more, for example 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, or 44 positions—in any combination, thereof) corresponding to M8, V51, N62, 171, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, or T571 in Φ29 polymerase.

Such a modification may comprise a deletion (e.g., a deletion of an amino acid at a position corresponding to M8, V51, N62, 171, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, or T571 (or any combination thereof) in Φ29 polymerase).

Alternatively, or in addition, such a modification may comprise an addition (e.g., an addition of a homologous amino acid at a position corresponding to M8, V51, N62, 171, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, or T571 (or any combination thereof) in Φ29 polymerase).

Alternatively, or in addition, such a modification may comprise a substitution. For example, a modification may comprise a substitution at one or more positions (e.g., at 1-44 positions or any whole number between, for example 2 or more, 5 or more, 10 or more, 15 or more, 20 or more, for example all—and in any combination, thereof) corresponding to M8, V51, N62, 171, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, and T571 in Φ29 polymerase. In some embodiments, a substitution is selected from the group consisting of MBR, V51A, N62D, I71V, L107I, K131E, K135Q, L142K, Y148I, G197D, Y224K, Y226F, E239G, V250A, V250I, N251R, L253A, L253H, Y281H, I288L, T301C, R306Q, R308L, D325E, D341E, K354R, T368F, E375K, E375Y, K379R, Q380R, A437G, A444T, E466K, D476H, P477D, K478D, A484C, A484Q, A484N, A484E, A484D, A484K, A484R, A484H, A484Y, and A484X (where X represents an unnatural amino acid, as described herein), E508R, D510K, D510R, K512Y, E515Q, K539E, D570S, and T571V (corresponding to positions in Φ29 polymerase).

In some embodiments, a modified polymerase comprises one or more (e.g., 2 or more, 5 or more, 10 or more, 15 or more, 20 or more, for example all) amino acid mutations at positions corresponding to K131, K135, L142, Y148, Y224, E239, V250, L253, R306, R308, E375, A437, E466, D476, A484, E508, D510, K512, E515, K539, D570, and T571 in Φ29 polymerase.

B. Majority Polymerase Sequences

In some embodiments, modified polymerizing enzymes provided by the disclosure comprise a polymerase sequence according to a wild-type polymerase sequence (e.g., as set forth in TABLE 1) with one or more modifications (e.g., as exemplified in TABLES 2-6, or combinations of two or more thereof). In some embodiments, a wild-type polymerase amino acid sequence (e.g., as set forth in TABLE 1) provides a majority polymerase sequence in which one or more modifications may be made to generate a modified polymerase. As used herein, a "majority polymerase sequence" or "majority sequence" of a modified polymerase refers to a wild-type polymerase amino acid sequence that predominates within the modified polymerase amino acid sequence (e.g., where at least 50% of the amino acids in the modified polymerase sequence corresponds to amino acids in the majority sequence). In some embodiments, a modified polymerase sequence comprises a majority sequence further comprising one or more amino acid mutations. In some embodiments, one or more amino acid mutations comprise amino acids at positions corresponding to positions in homologous proteins. In some embodiments, a polymerase amino acid sequence set forth in any one of Tables 2-6 provides a majority polymerase sequence in which one or more modifications may be made to generate a modified polymerase.

In some embodiments, a modified polymerase has at least 25% amino acid sequence identity to one or more of the polymerases listed in TABLE 1 (e.g., to SEQ ID NO: 1, SEQ ID NOs: 2-5, SEQ ID Nos: 6-22, or SEQ ID Nos: 23-33 listed in TABLE 1). In some embodiments, a modified polymerase has 25-50%, 50-60%, 60-70%, 70-80%, 80-90%, 91%, 92%, 93%, 94%, 95%, 96%, 97%, 98%, 99%, or higher amino acid sequence identity to one or more of the polymerases listed in TABLE 1 (e.g., to SEQ ID NO: 1, SEQ ID NOs: 2-5, SEQ ID Nos: 6-22, or SEQ ID Nos: 23-33 listed in TABLE 1). In some embodiments, a modified polymerase has 25-50%, 50-60%, 60-70%, 70-80%, 80-90%, 91%, 92%, 93%, 94%, 95%, 96%, 97%, 98%, 99%, or higher amino acid sequence identity to any one of SEQ ID Nos: 2-5. In some embodiments, a modified polymerase has 25-50%, 50-60%, 60-70%, 70-80%, 80-90%, 91%, 92%, 93%, 94%, 95%, 96%, 97%, 98%, 99%, or higher amino acid sequence identity to SEQ ID NO: 2. In some embodiments, a modified polymerase has 25-50%, 50-60%, 60-70%, 70-80%, 80-90%, 91%, 92%, 93%, 94%, 95%, 96%, 97%, 98%, 99%, or higher amino acid sequence identity to any one of SEQ ID Nos: 23-33. In some embodiments, such a modified polymerase includes one or more of the amino acid mutations and/or domain substitutions described in the context of different modified polymerase configurations and/or examples provided in this application. In some embodiments, the only modifications in a modified polymerase are one or more of the modifications (e.g., amino acid substitutions) provided in this disclosure and the sequence of the polymerase is otherwise identical to a wild-type polymerase (e.g., a sequence of TABLE 1) or to a sequence described in any of TABLES 2-7.

Sequence identity may be in reference to the entire amino acid sequence of the modified polymerase. However, in some embodiments, sequence identity is in reference to one or more segments, subdomains, or domains of the modified polymerase. For example, in some embodiments, one or more segment, subdomain, or domain of a modified polymerase is described as having at least 50% amino acid sequence identity to a segment, subdomain, or domain of a reference polymerase listed in TABLE 1 (e.g., to SEQ ID NO: 1, SEQ ID NOs: 2-5, SEQ ID Nos: 6-22, or SEQ ID Nos: 23-33 listed in TABLE 1). Such segments, subdomains or domains may have, for example, 50-60%, 60-70%, 70-80%, 80-90%, 91%, 92%, 93%, 94%, 95%, 96%, 97%, 98%, 99%, or 100% sequence identity to a corresponding segment, subdomain, or domain of a reference polymerase listed in TABLE 1 (e.g., to SEQ ID NO: 1, SEQ ID NOs: 2-5, SEQ ID Nos: 6-22, or SEQ ID Nos: 23-33 listed in TABLE 1). In some embodiments, such segments, subdomains or domains may have, for example, 50-60%, 60-70%, 70-80%, 80-90%, 91%, 92%, 93%, 94%, 95%, 96%, 97%, 98%, 99%, or 100% sequence identity to a corresponding segment, subdomain, or domain of any one of SEQ ID Nos: 2-5. In some embodiments, such segments, subdomains or domain may have, for example, 50-60%, 60-70%, 70-80%, 80-90%, 91%, 92%, 93%, 94%, 95%, 96%, 97%, 98%, 99%, or 100% sequence identity to a corresponding segment, subdomain, or domain of SEQ ID NO: 2. In some embodiments, such segments, subdomains or domains may have, for example, 50-60%, 60-70%, 70-80%, 80-90%, 91%, 92%, 93%, 94%, 95%, 96%, 97%, 98%, 99%, or 100% sequence identity to a corresponding segment, subdomain, or domain of any one of SEQ ID NOs: 23-33.

For the purposes of comparing two or more amino acid sequences, the percentage of "sequence identity" between a first amino acid sequence and a second amino acid sequence (also referred to herein as "amino acid identity") may be calculated by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e., as an "amino acid difference" as defined herein. Alternatively, the degree of sequence identity between two amino acid sequences may be calculated using a known computer algorithm (e.g., by the local homology algorithm of Smith and Waterman (1970) Adv. Appl. Math. 2:482c, by the homology alignment algorithm of Needleman and Wunsch, J. Mol. Biol. (1970) 48:443, by the search for similarity method of Pearson and Lipman. Proc. Natl. Acad. Sci. USA (1998) 85:2444, or by computerized implementations of algorithms available as Blast, Clustal Omega, or other sequence alignment algorithms) and, for example, using standard settings. Usually, for the purpose of determining the percentage of "sequence identity" between two amino acid sequences in accordance with the calculation method outlined hereinabove, the amino acid sequence with the greatest number of amino acid residues will be taken as the "first" amino acid sequence, and the other amino acid sequence will be taken as the "second" amino acid sequence.

Additionally, or alternatively, two or more sequences may be assessed for the identity between the sequences. The terms "identical" or percent "identity" in the context of two or more nucleic acids or amino acid sequences, refer to two or more sequences or subsequences that are the same. Two sequences are "substantially identical" if two sequences have a specified percentage of amino acid residues or nucleotides that are the same (e.g., at least 80%, 85%, 90%, 95%, 96%, 97%, 98%, 99%, 99.5%, 99.6%, 99.7%, 99.8% or 99.9% identical) over a specified region or over the entire sequence, when compared and aligned for maximum correspondence over a comparison window, or designated region as measured using one of the following sequence comparison algorithms or by manual alignment and visual inspection. Optionally, the identity exists over a region that is at least about 25, 50, 75, or 100 amino acids in length, or more preferably over a region that is 100 to 150, 200 or more amino acids in length.

Additionally, or alternatively, two or more sequences may be assessed for the alignment between the sequences. The terms "alignment" or percent "alignment" in the context of two or more nucleic acids or amino acid sequences, refer to two or more sequences or subsequences that are the same. Two sequences are "substantially aligned" if two sequences have a specified percentage of amino acid residues or nucleotides that are the same (e.g., at least 80%, 85%, 90%, 95%, 96%, 97%, 98%, 99%, 99.5%, 99.6%, 99.7%, 99.8% or 99.9% identical) over a specified region or over the entire sequence, when compared and aligned for maximum correspondence over a comparison window, or designated region as measured using one of the following sequence comparison algorithms or by manual alignment and visual inspection. Optionally, the alignment exists over a region that is at least about 25, 50, 75, or 100 amino acids in length, or more preferably over a region that is 100 to 150, 200 or more amino acids in length.

(i) Modified *E. faecium* Polymerases

The present application is based in part on the recognition that a polymerase from *E. faecium* can be advantageously utilized as a reagent in in vitro polymerization reactions, such as single-molecule nucleic acid sequencing reactions. The inventors have recognized that the wild-type *E. faecium* polymerase displays robust strand displacement activity, high processivity with nucleotide substrates (e.g., greater than 70 kilobases), and an ability to utilize synthetic nucleotide analogs. FIG. 24 shows results from rolling-circle assays assessing the processivity of wild-type EF polymerase compared to known processive polymerase QTDE1.0. The inventors have further recognized that certain modifications (e.g., mutations, insertions, and/or substitutions) to the wild-type *E. faecium* polymerase further enhance these and other functional attributes to provide an improved reagent for nucleic acid sequencing reactions. As such, in some embodiments, a modified polymerase is a modified *E. faecium* polymerase (i.e., comprises a *E. faecium* polymerase majority sequence, such as any one of SEQ ID NOs: 2-5). FIG. 13A shows sequence identity between four naturally occurring *E. faecium* polymerase variants. FIG. 13B shows sequences identity shared between the variants. Sequences are listed by their NCBI protein database accession numbers. In some embodiments, a modified polymerase comprises a *E. faecium* polymerase majority sequence of SEQ ID NO: 2.

In some embodiments, a modified *E. faecium* polymerase comprises an amino acid modification (i.e., mutation) at one or more positions (e.g., at 1-117 positions or any whole number between, for example 2 or more, 5 or more, 10 or more, 15 or more, 20 or more, for example all—and in any combination, thereof) corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, and T571 in the reference E. faecium polymerase. A modified E. faecium polymerase may comprise one or more amino acid modifications relative to SEQ ID Nos: 2-5 or a sequence described in TABLE 2 or TABLE 7.

Such a modification may comprise a deletion (e.g., a deletion of an amino acid at a position corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, or T571 (or any combination thereof) in the reference E. faecium polymerase.

Alternatively, or in addition, such a modification may comprise an addition (e.g., an addition of a homologous amino acid at a position corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, or T571 (or any combination thereof) in the reference E. faecium polymerase).

Alternatively, or in addition, such a modification may comprise a substitution. For example, a modification may comprise a substitution at one or more positions (e.g., at 1-117 positions or any whole number between, for example 2 or more, 5 or more, 10 or more, 15 or more, 20 or more, for example all—and in any combination, thereof) corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, and T571 in E. faecium polymerase. In some embodiments, a substitution is selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, N145H, N145R, P147Q, P147T, I148K, I148H, I148R, E152D, I153V, P160A, D167P, D167K, D167H, D167R, D171K, D171H, D171R, N175T, N175Y, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, P273S, P273R, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, D374Q, D374H, I384T, I384F, I384S, E385Y, E385K, E385R, E385N, E385Q, E385L, E385A, N388T, E391Y, E391W, E391F, E391H, E391M, E391K, E391R, A396Q, N397L, G400L, D414V, D425N, R429G, E436R, E436G, L437Y, L437E, V443T, L445M, A446G, S447V, V449I, T450A, W452Y, G453A, Y455W, F465Y, N467R, N467H, N467S, N467T, T479V, E482K, E482H, E482R, A484E, E485D, A486E, L490M, D492H, D492K, D492R, D492A, H492S, S493P, K495R, K500E, S503A, S503T, Q506K, Q513D, D521K, D521R, D521H, E523R, E523V, E523Y, E523F, E523H, E523W, V526L, D533A, D533Q, D533T, D533R, D533S, R534K, E537K, E537H, E537R, E545K, E545H, E545R, G547S, L555K, L555P, P556A, R558H, T559V, V564L, T568D, T568S, M569K, M569T, M569V, and T571S (corresponding to positions in the reference E. faecium polymerase).

Exemplary modification combinations are listed in TABLE 7.

In some embodiments, a modified E. faecium polymerase does not comprise an amino acid modification (i.e., mutation) at one or more positions (e.g., 2 or more, 5 or more, 10 or more, 15 or more, 20 or more, for example 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, or 44 positions—in any combination, thereof) corresponding to M8, V51, N62, 171, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, or T571 in Φ29 polymerase (SEQ ID NO: 1).

In some embodiments, a modified E. faecium polymerase comprises at least one modification that alters a characteristic of the polymerase relative to the reference E. faecium polymerase. For example, a modification may result in: increased (or, alternatively decreased) processivity; increased (or, alternatively decreased) nuclease activity; increased (or, alternatively decrease) accuracy; increased (or, alternatively decrease) nucleotide substrate utilization (of one or more substrates); increased (or alternatively decreased) affinity toward one or more substrates; increased (or alternatively decreased) replication capacity; increased (or alternatively decreased) average read length; increased (or alternatively decreased) electropositive charge at the surface; or increased (or, alternatively decreased) stability.

In some embodiments, a modified E. faecium polymerase comprises one or more modifications that improves processivity. For example, in some embodiments, a modified polymerase comprises a mutation at one or more positions corresponding to T568 and M569 in E. faecium polymerase.

In some embodiments, a modified polymerase of the disclosure is a modified *E. faecium* polymerase comprising a mutation at one or both of T568 and M569. In some embodiments, the modified polymerase comprises one or more of: a mutation at T568 selected from T568D and T568S; and a mutation at M569 selected from M569T and M569V. In some embodiments, the modified *E. faecium* polymerase comprises mutations at each of T568 and K500.

In some embodiments, a modified *E. faecium* polymerase comprises a modification that eliminates or reduces exonuclease activity. For example, in some embodiments, the modified *E. faecium* polymerase comprises a mutation at N59 that eliminates or reduces exonuclease activity. In some embodiments, the modified *E. faecium* polymerase comprises N59D. In some embodiments, a modified *E. faecium* polymerase does not comprise a mutation at N59 (e.g., the modified *E. faecium* polymerase comprises N59). It should be appreciated that a mutation at N59 in a modified *E. faecium* polymerase can be introduced or reverted back to wild-type depending on a desired functionality. Accordingly, in some embodiments, a modified *E. faecium* polymerase comprises a sequence selected from TABLE 2, further modified to introduce a mutation at N59 (e.g., further modified to comprise N59D). In some embodiments, a modified *E. faecium* polymerase comprises a sequence selected from TABLE 2, further modified to revert a mutation at N59 back to wild-type (e.g., further modified to comprise D59N).

In some embodiments, a modified *E. faecium* polymerase comprises one or more modifications that improves nucleotide substrate utilization at the active site. In some embodiments, such a modification enhances the incorporation of a nucleotide or nucleotide analog (e.g., a nucleotide hexaphosphate) into a newly synthesized nucleic acid strand in a polymerization reaction. For example, in some embodiments, a modified polymerase comprises a mutation at one or more positions corresponding to V261, L264, S267, I384, E391, W452, G453, Y455, D492, and K500 in *E. faecium* polymerase. In some embodiments, a modified polymerase of the disclosure is a modified *E. faecium* polymerase comprising a mutation at one or more of V261, L264, S267, I384, E391, W452, G453, Y455, D492, and K500. In some embodiments, the modified *E. faecium* polymerase comprises one or more of: a mutation at V261 selected from V261A and V261I; a mutation at L264 selected from L264A, L264H, and L264M; S267A; a mutation at I384 selected from I384F and I384S; a mutation at E391 selected from E391Y, E391W, E391F, E391H, E391M, E391K, and E391R; W452Y; G453A; Y455W; D492H; and K500E. In some embodiments, a modified polymerase of the disclosure is a modified *E. faecium* polymerase comprising mutations at each of V261, L264, S267, I384, E391, W452, G453, Y455, D492, and K500. In some embodiments, the modified *E. faecium* polymerase comprises V261A, L264H, and K500E.

In some embodiments, a modified *E. faecium* polymerase comprises a segment insertion that improves nucleotide substrate utilization at the active site. For example, based on a structural homology analysis, it was determined that wild-type *E. faecium* polymerase does not contain a structural motif proximal to the active site as found in the palm domain of Φ29 polymerase. This structural motif, spanning D503 to K525 in the Φ29 sequence, forms favorable interactions with nucleotide analogs (e.g., nucleotide hexaphosphates), which improves performance in sequencing reactions. FIGS. 14A-14B show comparisons of *E. faecium* polymerase and Φ29. In some embodiments, an active site modification comprises a segment insertion that replaces amino acids at positions 519 through 522 in *E. faecium* polymerase (E519 through G522) with a segment corresponding to positions D503 through K525 in Φ29 polymerase (e.g., a segment comprising a sequence spanning D503 through K525 in Φ29 polymerase, or a homologous segment in M2Y polymerase). In some embodiments, the segment insertion comprises one or more mutations at positions corresponding to E508, D510, K512, and E515Q in Φ29 polymerase. In some embodiments, the segment insertion comprises one or more mutations selected from E508R, D510R, K512Y, and E515Q. In some embodiments, the segment insertion replaces amino acids at positions 519 through 522 in *E. faecium* polymerase (EIKG, SEQ ID NO: 840) with a segment comprising an amino acid sequence of DIYAKRVRGYLIECSPDEATTTK (SEQ ID NO: 841). In some embodiments, the segment insertion replaces amino acids at positions 519 through 522 in *E. faecium* polymerase (EIKG, SEQ ID NO: 840) with a segment comprising an amino acid sequence of DIYMKRVRGYLVQGSPDDYTDIK (SEQ ID NO: 842).

In some embodiments, a modified *E. faecium* polymerase comprises one or more modifications that enhance polymerization accuracy. For example, in some embodiments, a modified polymerase comprises a mutation at one or more positions corresponding to E65, Y133, V261, L264, S267, I384, E391, G400, V443, L445, A446, S447, V449, T450, W452, G453, Y455, K500, S503, E523, L555, and P556 in *E. faecium* polymerase. In some embodiments, a modified polymerase of the disclosure is a modified *E. faecium* polymerase comprising a mutation at one or more of E65, Y133, V261, L264, S267, I384, E391, G400, V443, L445, A446, S447, V449, T450, W452, G453, Y455, K500, S503, E523, L555, and P556. In some embodiments, a modified *E. faecium* polymerase comprises one or more of: E65S; Y133L; a mutation at V261 selected from V261A and V261I; a mutations at L264 selected from L264A and L264H; S267A; a mutation at I384 selected from I384F, I384S; a mutation a E391 selected from E391Y, E391W, E391F, and E391K; G400L; V443T; L445M; A446G; S447V; V449I; T450A; W452Y; G453A; Y455W; K500E; S503A; a mutation a E523 selected from E523K, E523Y, E523F, E523H, and E523W; L555K; and P556A.

In some embodiments, a modified *E. faecium* polymerase comprises one or more modifications that enhance DNA binding. For example, in some embodiments, a modified polymerase comprises a mutation at one or more positions corresponding to Q317, S319, I322, Q323, R429, L555, and T559 in *E. faecium* polymerase. In some embodiments, a modified polymerase of the disclosure is a modified *E. faecium* polymerase comprising a mutation at one or more of Q317, S319, I322, Q323, R429, L555, and T559. In some embodiments, the modified polymerase comprises one or more of: Q317R; S319R; I322K; Q323G; R429G; L555K; and T559V.

In some embodiments, a modified *E. faecium* polymerase comprises one or more modifications that enhance analog binding. For example, in some embodiments, a modified polymerase comprises a mutation at one or more positions corresponding to E391, S503 and E523 in *E. faecium* polymerase. In some embodiments, a modified polymerase of the disclosure is a modified *E. faecium* polymerase comprising a mutation at one or more of E391, S503 and E523. In some embodiments, the modified polymerase comprises one or more of: at mutation at E391 selected from E391Y, E391W, E391F, and E391K; S503A; and a mutation at E523 selected from E523K, E523Y, E523F, E523H, and E523W.

In some embodiments, a modified *E. faecium* polymerase comprises one or more modifications that enhance strand displacement. For example, in some embodiments, a modified polymerase comprises a mutation at one or more positions corresponding to Q206, E436 and L437 in *E. faecium* polymerase. In some embodiments, a modified polymerase of the disclosure is a modified *E. faecium* polymerase comprising a mutation at one or more of Q206, E436 and L437. In some embodiments, the modified polymerase comprises one or more of: a mutation at Q206 selected from Q206R, Q206K and Q206H; E436R; and a mutation at L437 selected from L437Y and L437E.

In some embodiments, a modified *E. faecium* polymerase comprises one or more modifications that enhance average read length. For example, in some embodiments, a modified polymerase comprises a mutation at one or more positions corresponding to E436, L437, R534, T568, and M569 in *E. faecium* polymerase. In some embodiments, a modified *E. faecium* polymerase comprises a mutation at one or more of E436, L437, R534, T568, and M569. In some embodiments, the modified polymerase comprises one or more of: E436R; a mutation at L437 selected from L437Y and L437E; R534K; a mutation at T568 selected from T568D and T568S; and a mutation at M569 selected from M569T and M569V.

In some embodiments, a modified *E. faecium* polymerase comprises one or more modifications that enhance replication capacity (e.g., at 45° C.). For example, in some embodiments, a modified polymerase comprises a mutation at one or more positions corresponding to T13, V25, C26, D27, N33, I34, F36, S42, D54, E60, M95, T110, T114, K119, P136, P147, E152, I153, P160, N175, F188, S216, R217, D232, A236, V247, P273, P275, E283, V315, S319, L320, Q323, E338, T345, F352, F353, T364, D414, D425, E436, F465, E485, A486, L490, S503, E523, V526, G547, L555, R558, V564, M569, and T571 in *E. faecium* polymerase. In some embodiments, a modified polymerase of the disclosure is a modified *E. faecium* polymerase comprising a mutation at one or more of T13, V25, C26, D27, N33, I34, F36, S42, D54, E60, M95, T110, T114, K119, P136, P147, E152, I153, P160, N175, F188, S216, R217, D232, A236, V247, P273, P275, E283, V315, S319, L320, Q323, E338, T345, F352, F353, T364, D414, D425, E436, F465, E485, A486, L490, S503, E523, V526, G547, L555, R558, V564, M569, and T571. In some embodiments, the modified polymerase comprises one or more of: T13N; V25L; C26W; D27E; N33T; I34V; F36V; S42T; D54Y; E60V; a mutation at position M95 selected from M95T and M95K; T110I; T114S; K119Q; P136T; a mutation a position P147 selected from P147Q and P147T; E152D; I153V; P160A; N175Y; F188C; a mutation at position S216 selected from S216G and S216R; R217G; D232H; A236G; V247D; P273R; P275S; E283K; V315L; S319R; a mutation at position L320 selected from L320M and L320T; Q323R; E338K; T345I; F352I; F353C; T364I; D414V; D425N; E436G; F465Y; E485D; A486E; L490M; S503T; E523V; V526L; G547S; L555R; R558H; V564L; M569K; and T571S.

In some embodiments, a modified *E. faecium* polymerase comprises one or more modifications that increase electropositive charge at the protein surface. Similarly, in some embodiments, a modified *E. faecium* polymerase comprises an increased isoelectric point. In some embodiments, a modified *E. faecium* polymerase has an isoelectric point that is 0.1, 0.2, 0.3, 0.4, 0.5, 0.6, 0.7, 0.8, 0.9, 1.0, 1.0-1.5, 1.5-2.0, 2.0-2.5, 2.5-3.0, 3.0-3.5, 3.5-4.0, 4.0-4.5, 5.0-5.5, 5.5-6.0, 6.0-6.5, 6.5-7.0, 7.0-7.5, 7.5-8.0, 8.0-8.5, 8.5-9.0, 9.0-9.5, or 9.5-10.0 isoelectric point (pI) units higher than the isoelectric point of wild-type *E. faecium* polymerase (e.g., SEQ ID NO: 2). Methods of measuring surface charge and isoelectric points are known to those having ordinary skill in the art. The isoelectric point (pI) is a standard concept in protein biochemistry with which the skilled person would be familiar. The pI is the pH value at which a protein displays a net charge of zero. An increase in pI means that a higher pH value is required for the protein to display a net charge of zero. Thus, an increase in pI represents an increase in the net positive charge of a protein at a given pH. Methods of determining the pI of a protein are known in the art. For example, the pI of a protein can be calculated from the average pKa values of each amino acid present in the protein ("calculated pI"). Such calculations can be performed using computer programs known in the art (e.g., Protein Calculator from the Scripps Research Institute and Compute pI/MW Tool from ExPASy). Comparisons of pI values between different molecules should be made using the same calculation technique/program. Where appropriate, the calculated pI of a protein can be confirmed experimentally using the technique of isoelectric focusing ("observed pI"). This technique uses electrophoresis to separate proteins according to their pI. Isoelectric focusing is typically performed using a gel that has an immobilised pH gradient. When an electric field is applied, the protein migrates through the pH gradient until it reaches the pH at which it has zero net charge, this point being the pI of the protein. Results provided by isoelectric focusing may be relatively low-resolution in nature, and thus in some embodiments, the results provided by calculated pI (as described above) are more appropriate to use.

In some embodiments, such surface charge modifications enhance the rate of incorporation of nucleotide analogs that comprise an electronegative component (e.g., a nucleic acid linker) by providing a protein surface that is more attractive toward the nucleotide analog. In some embodiments, a modified polymerase comprises a mutation at one or more positions corresponding to E139, E142, N145, I148, D167, D171, D189, D374, E385, E391, N467, E482, D492, K495, D521, E523, D533, E537, and E545 in *E. faecium* polymerase. In some embodiments, a modified polymerase of the disclosure is a modified *E. faecium* polymerase comprising a mutation at one or more of E139, E142, N145, I148, D167, D171, D189, D374, E385, E391, N467, E482, D492, K495, D521, E523, D533, E537, and E545. In some embodiments, the modified polymerase comprises one or more of: a mutation at E139 selected from E139K, E139Q, E139R, and E139H; a mutation at E142 selected from E142K, E142H, E142R, and E142Q; a mutation at N145 selected from N145K, N145H, and N145R; a mutation at 1148 selected from I148K, I148H, and I148R; a mutation at D167 selected from D167P, D167K, D167H, and D167R; a mutation at D171 selected from D171K, D171H, and D171R; a mutation at D189 selected from D189K, D189H, and D189R; a mutation at D374 selected from D374G, D374Q, and D374H; a mutation at E385 selected from E385Y, E385K, E385R, E385N, E385Q, E385L, and E385A; a mutation at E391 selected from E391Y, E391W, E391K, and E391F; a mutation a N467 selected from N467R, N467K, N467H, N467S, and N467T; a mutation at E482 selected from E482K, E482H, and E482R; a mutation at D492 selected from D492H, D492K, and D492R; K495R; a mutation at D521 selected from D521K, D521H, and D521R; a mutation at E523 selected from E523K, E523Y, E523H, E523R, E523F, and E523W; a mutation at D533 selected from D533A, D533Q, D533T, D533R, and D533S; a mutation at E537 selected from E537K, E537H, and E537R; and a mutation at E545 selected from E545K, E545H, and E545R.

In some embodiments, a modified *E. faecium* polymerase comprises one or more modifications that enhance protein stability (e.g., enhance thermostability, protein yield, and/or active polymerase population). For example, in some embodiments, a modified polymerase comprises a mutation at one or more positions corresponding to K4, S22, D27, I34, D54, E60, E85, M95, N106, T110, Q122, Y133, P136, P147, D167, T211, D232, P275, R308, S319, L320, E323, D337, E338, D341, T345, F352, T364, D414, F465, T479, E485, L490, S493, Q513, and R558 in *E. faecium* polymerase. In some embodiments, a modified polymerase of the disclosure is a modified *E. faecium* polymerase comprising a mutation at one or more of K4, S22, D27, I34, D54, E60, E85, M95, N106, T110, Q122, Y133, P136, P147, D167, T211, D232, P275, R308, S319, L320, Q323, D337, E338, D341, T345, F352, T364, D414, F465, T479, E485, L490, S493, Q513, and R558. In some embodiments, the modified polymerase comprises one or more of: K4R; S22A; D27E; I34V; D54Y; a mutation at E60 selected from E60V and E60L; E85P; M95K; T110I; N106G; Q122V; Y133L; P136T; a mutation at P147 selected from P147Q and P147T; D167P; T211A; D232K; P275S; R308G; S319R; L320M; Q323V; D337G; E338K; D341T; T345I; F352I; T364I; D414V; F465Y; T479V; E485D; L490M; S493P; Q513D; and R558H.

In some embodiments, a modified *E. faecium* polymerase comprises one or more modifications that enhance performance in a polymerization reaction (e.g., by improved accuracy, increased read length, and/or increased speed). In some embodiments, a modified polymerase comprises enhancing mutations at one or more positions corresponding to E142, V261, L264, S319, E391, L437, E482, D492, K500, E519, D521, E523, T568, and M569 in *E. faecium* polymerase. In some embodiments, a modified *E. faecium* polymerase comprises mutations at one or more of E142, V261, L264, S319, E391, L437, E482, D492, K500, E519, D521, E523, T568, and M569. In some embodiments, the modified polymerase comprises one or more of: a mutation at E142 selected from E142K and E142Q; a mutation at V261 selected from V261A and V261I; a mutation at L264 selected from L264A, L264H, and L264M; a mutation at E391 selected from E391Y, E391W, E391F, E391H, E391M, E391K, and E391R; a mutation at D521 selected from D521R and D521K; a mutation at E523 selected from E523Y and E523K; and a mutation selected from S319L, L437Y, E482K, D492H, K500E, E519R, T568S, and M569V.

It should be appreciated that, for the purposes of the disclosure, the *E. faecium* polymerase modifications described herein may be classified according to different functional enhancements or different structural domains. Advantageously, a modified *E. faecium* polymerase of the disclosure comprises a plurality of modifications selected from the different functional and/or structural classifications described herein. This is exemplified by the modified *E. faecium* polymerase variants that were engineered in accordance with embodiments described herein, listed in TABLE 2. In some embodiments, a modified *E. faecium* polymerase comprises an amino acid sequence that is at least 25-50%, 50-60%, 60-70%, 70-80%, 80-90%, 91%, 92%, 93%, 94%, 95%, 96%, 97%, 98%, 99%, or 100% identical to any one of SEQ ID Nos: 34-305, provided in TABLE 2. In some embodiments, a modified *E. faecium* polymerase comprises the amino acid sequence of any one of SEQ ID Nos: 34-305. In some embodiments, a modified *E. faecium* polymerase consists of an amino acid sequence that is at least 25-50%, 50-60%, 60-70%, 70-80%, 80-90%, 91%, 92%, 93%, 94%, 95%, 96%, 97%, 98%, 99%, or 100% identical to any one of SEQ ID Nos: 34-305, provided in TABLE 2. In some embodiments, a modified *E. faecium* polymerase consists of an amino acid sequence of any one of SEQ ID Nos: 34-305. In some embodiments, a modified *E. faecium* polymerase comprises an amino acid sequence that is at least 25-50%, 50-60%, 60-70%, 70-80%, 80-90%, 91%, 92%, 93%, 94%, 95%, 96%, 97%, 98%, 99%, or 100% identical to SEQ ID NO: 88, SEQ ID NO: 157, or SEQ ID NO: 180. In some embodiments, a modified *E. faecium* polymerase comprises the amino acid sequence of SEQ ID NO: 88, SEQ ID NO: 157, or SEQ ID NO: 180. In some embodiments, a modified *E. faecium* polymerase consists of the amino acid sequence of SEQ ID NO: 88, SEQ ID NO: 157, or SEQ ID NO: 180.

In some embodiments, the only modifications in a modified polymerase are one or more of the modifications (e.g., amino acid substitutions in *E. faecium* polymerase) provided in this disclosure and the sequence of the polymerase is otherwise identical to a wild-type polymerase (e.g., SEQ ID Nos: 2-5) or to a sequence described in TABLE 2 or TABLE 7.

(ii) Modified Φ29 Polymerases

In some embodiments, a modified polymerase is a modified Φ29 polymerase (i.e., comprises a Φ29 polymerase majority sequence, such as SEQ ID NO: 1).

In some embodiments, a modified Φ29 polymerase comprises an amino acid modification (i.e., mutation) at one or more positions (e.g., 2 or more, 5 or more, 10 or more, 15 or more, 20 or more, for example 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, or 44 positions—in any combination, thereof) corresponding to M8, V51, N62, I71, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, or T571 in the reference Φ29 polymerase.

Such a modification may comprise a deletion (e.g., a deletion of an amino acid at a position corresponding to M8, V51, N62, I71, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, or T571 (or any combination thereof) in the reference Φ29 polymerase).

Alternatively, or in addition, such a modification may comprise an addition (e.g., an addition of a homologous amino acid at a position corresponding to M8, V51, N62, I71, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, or T571 (or any combination thereof) in the reference 129 polymerase).

Alternatively, or in addition, such a modification may comprise a substitution. For example, a modification may comprise a substitution at one or more positions (e.g., at 1-44 positions or any whole number between, for example 2 or more, 5 or more, 10 or more, 15 or more, 20 or more, for example all—and in any combination, thereof) corresponding to M8, V51, N62, I71, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, and T571 in Φ29 polymerase. In some embodiments, a substitution is selected from the group consisting of M8R, V51A, N62D, I71V, L107I, K131E, K135Q, L142K, Y148I, G197D, Y224K, Y226F, E239G, V250A, V250I, N251R, L253A, L253H, Y281H, I288L, T301C, R306Q, R308L, D325E, D341E, K354R, T368F, E375K, E375Y, K379R, Q380R, A437G, A444T, E466K, D476H, P477D, K478D, A484C, A484Q, A484N, A484E, A484D, A484K, A484R, A484H, A484Y, and A484X (where X represents an unnatural amino acid, as described herein), E508R, D510K, D510R, K512Y, E515Q, K539E, D570S, and T571V (corresponding to positions in the reference Φ29 polymerase).

For example, in some embodiments, where a modified polymerase comprises a Φ29 polymerase majority sequence, the modified polymerase comprises one or more mutations at the positions as listed in the preceding. In some embodiments, where a modified polymerase does not comprise a Φ29 polymerase majority sequence, the modified polymerase comprises one or more amino acids that correspond to the positions listed above, e.g., as determined by homology alignment or other methods known in the art.

In some embodiments, a modified polymerase comprises mutations at one or more positions corresponding to Y148, Y226, V250, N251, T368, E375, K379, Q380, A437, P477, K478, and A484 in Φ29 polymerase. In some embodiments, a modified polymerase of the disclosure is a modified Φ29 polymerase comprising mutations at one or more of Y148, Y226, V250, N251, T368, E375, K379, Q380, A437, P477, K478, and A484. In some embodiments, the modified polymerase comprises one or more of Y148I, Y226F, V250A, N251R, T368F, E375K, K379R, Q380R, A437G, P477D, K478D, and A484C. In some embodiments, the modified polymerase comprises one or more of Y148I, Y226F, V250A, N251R, T368F, E375K, K379R, Q380R, A437G, P477D, K478D, and A484S. In some embodiments, the modified polymerase comprises one or more of Y148I, Y226F, V250A, N251R, T368F, E375K, K379R, Q380R, A437G, P477D, K478D, and A484T. In some embodiments, the modified polymerase comprises one or more of Y148I, Y226F, V250A, N251R, T368F, E375K, K379R, Q380R, A437G, P477D, K478D, and A484Q. In some embodiments, the modified polymerase comprises one or more of Y148I, Y226F, V250A, N251R, T368F, E375K, K379R, Q380R, A437G, P477D, K478D, and A484N. In some embodiments, the modified polymerase comprises one or more of Y148I, Y226F, V250A, N251R, T368F, E375K, K379R, Q380R, A437G, P477D, K478D, and A484E. In some embodiments, the modified polymerase comprises one or more of Y148I, Y226F, V250A, N251R, T368F, E375K, K379R, Q380R, A437G, P477D, K478D, and A484D. In some embodiments, the modified polymerase comprises one or more of Y148I, Y226F, V250A, N251R, T368F, E375K, K379R, Q380R, A437G, P477D, K478D, and A484K. In some embodiments, the modified polymerase comprises one or more of Y148I, Y226F, V250A, N251R, T368F, E375K, K379R, Q380R, A437G, P477D, K478D, and A484R. In some embodiments, the modified polymerase comprises one or more of Y148I, Y226F, V250A, N251R, T368F, E375K, K379R, Q380R, A437G, P477D, K478D, and A484H. In some embodiments, the modified polymerase comprises one or more of Y148I, Y226F, V250A, N251R, T368F, E375K, K379R, Q380R, A437G, P477D, K478D, and A484Y. In some embodiments, the modified polymerase comprises one or more of Y148I, Y226F, V250A, N251R, T368F, E375K, K379R, Q380R, A437G, P477D, K478D, and A484X, where X represents an unnatural amino acid, as described herein. As used herein, one or more can be 2 or more, 4 or more, 6 or more, 8 or more, 10 or more, 12 or more, for example all, of the listed amino acid substitutions.

In some embodiments, a modified polymerase comprises mutations at one or more positions (e.g., at 1-35 positions or any whole number in between, for example 2 or more, 5 or more, 10 or more, 15 or more, 20 or more, for example all) corresponding to M8, V51, N62, I71, L107, K131, K135, L142, G197, Y224, E239, V250, L253, Y281, I288, T301, R306, R308, D325, D341, K354, T368, E375, A437, A444, E466, D476, A484, E508, D510, K512, E515, K539, D570, and T571 in Φ29 polymerase. In some embodiments, a modified polymerase is a modified Φ29 polymerase comprising mutations at one or more of M8, V51, N62, I71, L107, K131, K135, L142, G197, Y224, E239, V250, L253, Y281, I288, T301, R306, R308, D325, D341, K354, T368, E375, A437, A444, E466, D476, A484, E508, D510, K512, E515, K539, D570, and T571 in Φ29 polymerase. In some embodiments, the modified polymerase comprises one or more (e.g., 1-35 or any whole number in between, for example 2 or more, 5 or more, 10 or more, 15 or more, 20 or more, for example all) of the following mutations M8R, V51A, N62D, I71V, L107I, K131E, K135Q, L142K, G197D, Y224K, E239G, V250A, V250I, L253A, L253H, Y281H, I288L, T301C, R306Q, R308L, D325E, D341E, K354R, T368F, E375Y, A437G, A444T, E466K, D476H, A484E, E508R, D510K, D510R, K512Y, E515Q, K539E, D570S, and T571V.

In some embodiments, a modified polymerase comprises mutations at one or more positions (e.g., at 1-18 positions or any whole number in between, for example 2 or more, 5 or more, 10 or more, 15 or more, for example all) corresponding to K135, L142, Y224, E239, V250, L253, E375, A437, E466, D476, A484, E508, D510, K512, E515, K539, D570, and T571 in Φ29 polymerase. In some embodiments, a modified polymerase of the disclosure is a modified Φ29 polymerase comprising mutations at one or more of K135, L142, Y224, E239, V250, L253, E375, A437, E466, D476, A484, E508, D510, K512, E515, K539, D570, and T571. In some embodiments, the modified polymerase comprises one or more (e.g., 1-18 or any whole number in between, for example 2 or more, 5 or more, 10 or more, 15 or more, for example all) of K135Q, L142K, Y224K, E239G, V250I, L253A, E375Y, A437G, E466K, D476H, A484E, E508R, D510R, K512Y, E515Q, K539E, D570S, and T571V.

In some embodiments, a modified polymerase comprises mutations at one or more positions (e.g., 1, 2, or 3) corresponding to G197, I71, and L107 in Φ29 polymerase. In some embodiments, a modified polymerase of the disclosure is a modified Φ29 polymerase comprising mutations at one or more (e.g., 1, 2, or 3) of G197, I71, and L107. In some embodiments, the modified polymerase comprises one or more (e.g., 1, 2, or 3) of G197D, I71V, and L107I.

C. Domain, Subdomain, and Segment Modifications

As described above, modifications may comprise an addition, substitution, or deletion of one or more amino acids (which may or may not be consecutive), such as: (i) an addition, substitution, or deletion of an amino acid within a polymerase domain, subdomain, or segment; or (i) an addition, substitution, or deletion of a polymerase domain, subdomain, or segment.

FIG. 2, FIG. 9B, and FIG. 15 provide exemplary polymerase domains and subdomains. For example, FIG. 2 depicts a cartoon illustration of Φ29 polymerase 200. The folded, three-dimensional structure comprises distinct domains and subdomains corresponding to overlay 202: an N-terminal exonuclease domain (1) and a C-terminal polymerase domain that contains a palm subdomain (2), a terminal protein region 1 subdomain (TPR1) (3), a fingers subdomain (4), a TPR2 subdomain (5), and a thumb subdomain (6). These domains and subdomains map to areas of the polypeptide strand according to polypeptide construct 204, which is oriented in an N-terminal to C-terminal fashion. As shown, the N-terminal exonuclease domain (1) spans residues 1-189 and the C-terminal polymerase domain spans residues 190-575 of wild-type Φ29 polymerase. Within the C-terminal polymerase domain, the palm subdomain (2) spans residues 190-260 and 427-530, the TPR1 subdomain (3) spans residues 261-358, the fingers subdomain (4) spans residues 359-394, the TPR2 subdomain (5) spans residues 395-426, and the thumb subdomain (6) spans residues 531-575 of wild-type Φ29 polymerase.

A polymerase "segment," as used herein, refers to a portion (e.g., at least 2 consecutive more amino acids) of a polymerase. In some embodiments, a segment comprises at least 2, at least 3, at least 4, at least 5, at least 10, at least 15, at least 20, at least 25, at least 30, at least 35, at least 40, at least 45, at least 50, at least 55, at least 60, at least 65, at least 70, at least 75, at least 80, at least 85, at least 90, at least 95, at least 100, at least 110, at least 120, at least 130, at least 140, at least 150, at least 160, at least 170, at least 180, at least 190, at least 200, at least 210, at least 220, at least 230, at least 240, at least 250, at least 275, or at least 300 consecutive amino acids of a polymerase. In some embodiments, a segment comprises 2, 3, 4, 5, 6, 7, 8, 9, 10, 11, 12, 13, 14, 15, 16, 17, 18, 9, 20, 21, 22, 23, 44, 25, 26, 27, 28, 29, 30, 31, 32, 33, 34, 35, 36, 37, 38, 9, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 105, 110, 115, 120, 125, 130, 140, or 150 consecutive amino acids of a polymerase. In some embodiments, a segment comprises a domain or a subdomain of a polymerase.

(i) Modifications within a Polymerase Domain, Subdomain, or Segment

In some embodiments, a recombinant polymerizing enzyme of the present application comprises one or more amino acid mutations in one or more domains, subdomains, or segments (optionally including flanking amino acids) of the polymerase. In some embodiments, the recombinant polymerizing enzyme comprises one or more amino acid mutations in one or more of an exonuclease region, a palm region, a TPR1 region, a fingers region, a TPR2 region, and a thumb region.

In some embodiments, a recombinant polymerizing enzyme comprises mutations at one or more positions in an exonuclease region (e.g., an exonuclease loop of an exonuclease region). In some embodiments, a recombinant polymerizing enzyme having an E. faecium polymerase majority sequence comprises mutations at one or more positions in an exonuclease region. For example, in some embodiments, a recombinant polymerizing enzyme of the disclosure is a modified E. faecium polymerase comprising mutations at one or more of (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, or 36 of—in any combination) K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, and D189 in an exonuclease region of E. faecium polymerase. In some embodiments, a recombinant polymerizing enzyme comprises a mutation at one or more positions (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, or 36 positions—in any combination) corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, and D189 in E. faecium polymerase. Accordingly, in some embodiments, where a recombinant polymerizing enzyme does not comprise an E. faecium polymerase majority sequence, the recombinant polymerizing enzyme comprises one or more amino acids that correspond to the positions listed above, e.g., as determined by homology alignment or other methods known in the art. In some embodiments, the recombinant polymerizing enzyme comprises one or more of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, N145H, N145R, P147Q, P147T, I148K, I148H, I148R, E152D, I153V, P160A, D167P, D167K, D167H, D167R, D171K, D171H, D171R, N175T, N175Y, F188C, D189K, D189H, and D189R.

In some embodiments, a modified E. faecium polymerase of the disclosure comprises a modification that eliminates or reduces exonuclease activity. For example, in some embodiments, the modified E. faecium polymerase comprises a mutation at N59 that eliminates or reduces exonuclease activity. In some embodiments, the modified E. faecium polymerase comprises N59D. In some embodiments, a modified E. faecium polymerase does not comprise a mutation at N59 (e.g., the modified E. faecium polymerase comprises N59). It should be appreciated that a mutation at N59 in a modified E. faecium polymerase can be introduced or reverted back to wild-type depending on a desired functionality. Accordingly, in some embodiments, a modified E. faecium polymerase comprises a sequence selected from TABLE 2, further modified to introduce a mutation at N59 (e.g., further modified to comprise N59D). In some embodiments, a modified E. faecium polymerase comprises a sequence selected from TABLE 2, further modified to revert a mutation at N59 back to wild-type (e.g., further modified to comprise D59N).

In some embodiments, a modified polymerase having a Φ29 polymerase majority sequence comprises mutations at one or more positions in an exonuclease region. For example, in some embodiments, a modified polymerase of the disclosure is a modified Φ29 polymerase comprising mutations at one or more of (e.g., 2, 3, 4, 5, 6, 7, 8, 9, 10, or 11 of—in any combination) E75, R76, S82, A83, D84, G85, L86, P87, N88, Y90, and N91 in an exonuclease region of Φ29 polymerase. In some embodiments, a modified polymerase comprises one or more amino acid mutations at positions corresponding to E75, R76, S82, A83, D84, G85, L86, P87, N88, Y90, and N91 in 129 polymerase. Accordingly, in some embodiments, where a modified polymerase does not comprise a Φ29 polymerase majority sequence, the modified polymerase comprises one or more amino acids that correspond to the positions listed above, e.g., as determined by homology alignment or other methods known in the art. In some embodiments, the modified polymerase comprises one or more of E75F, R76K, S82C, A83K, D84E, G85A, L86K, P87E, N88R, Y90F, and N91S. Accordingly, in some embodiments, a segment comprising an exonuclease domain or portion thereof is swapped for a corresponding exonuclease domain from a different polymerase.

For example, in some embodiments, a segment comprising a loop and flanking amino acids of an exonuclease domain of one polymerase are replaced with a corresponding segment from another polymerase. For example, in some embodiments, a Φ29 E75-N91 segment is replaced with a corresponding F72-S89 segment from *E. faecium*. In some embodiments, swapping a segment comprising an exonuclease loop can reduce the interpulse distance of a polymerase.

In some embodiments, a modified polymerase comprises mutations at one or more positions in a TPR1 region. For example, in some embodiments, a modified polymerase comprises a mutation at one or more positions (e.g., 1, 2, 3, 4, 5, 6, or 7—in any combination) corresponding to P273, P275, R308, V315, Q317, S319, L320, I322, Q323, D337, E338, D341, T345, F352, F353, T364, and D374 in *E. faecium* polymerase. In some embodiments, a modified polymerase of the disclosure is a modified *E. faecium* polymerase comprising a mutation at one or more (e.g., 1, 2, 3, 4, 5, 6, or 7—in any combination) of R308, S319, L320, E323, D337, E338, and D341. In some embodiments, amino acids at one or more (e.g., 1, 2, 3, 4, 5, 6, or 7) of R308, S319, L320, E323, D337, E338, and D341 are changed to amino acids at corresponding positions in other polymerases (e.g., Φ29, M2Y, *Lucilia cuprina*, a *Bacillus* strain, for example GA-1). In some embodiments, the modified polymerase comprises one or more (e.g., 1, 2, 3, 4, 5, 6, or 7—in any combination) of R308G, S319L, L320M, E323V, D337G, E338K, and D341T.

In some embodiments, a modified polymerase comprises a mutation at one or more (e.g., 1, 2, 3, 4, 5, or 6—in any combination) positions corresponding to Y281, I288, T301, D325, D341, and K354 in Φ29 polymerase. In some embodiments, a modified polymerase of the disclosure is a modified Φ29 polymerase comprising mutations at one or more (e.g., 1, 2, 3, 4, 5, or 6—in any combination) of Y281, I288, T301, D325, D341, and K354. In some embodiments, amino acids at one or more (e.g., 1, 2, 3, 4, 5, or 6—in any combination) of Y281, I288, T301, D325, D341, and K354 are changed to amino acids at corresponding positions in other polymerases (e.g., M2Y, *Lucilia cuprina*, a *Bacillus* strain, for example GA-1). In some embodiments, the modified polymerase comprises one or more (e.g., 1, 2, 3, 4, 5, or 6—in any combination) of Y281H, I288L, T301C, D325E, D341E, and K354R. In some embodiments, mutations at one or more (e.g., 1, 2, 3, 4, 5, or 6) positions corresponding to Y281, I288, T301, D325, D341, and K354 in Φ29 polymerase increase rate of incorporation (e.g., in a single molecule sequencing reaction).

In some embodiments, a modified polymerase comprises a mutation at one or more positions in a palm region. For example, in some embodiments, a modified polymerase comprises a mutation at one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, or 39—in any combination) positions corresponding to Q206, T211, S216, R217, D232, A236, V247, I253, V261, L264, S267, V443, L445, A446, S447, V449, T450, W452, G453, Y455, F465, N467, T479, E482, A484, E485, A486, L490, D492, S493, K495, K500, S503, Q506, Q513, E519, D521, E523, and V526 in *E. faecium* polymerase. In some embodiments, a modified polymerase of the disclosure is a modified *E. faecium* polymerase comprising mutations at one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, or 39—in any combination) of T211, D232, V261, L264, T479, E482, D492, S493, K500, Q513, E519, D521, and E523. In some embodiments, amino acids at one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, or 39—in any combination) of T211, D232, V261, L264, T479, E482, D492, S493, K500, Q513, E519, D521, and E523 are changed to amino acids at corresponding positions in other polymerases (e.g., Φ29, M2Y, *Lucilia cuprina*, a *Bacillus* strain, for example GA-1). In some embodiments, a modification is selected from the group consisting of Q206R, Q206K, Q206H, T211A, S216G, S216R, R217G, D232K, A236G, V247D, I253H, I253A, V261A, V261I, V261L, L264H, L264A, L264M, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S503A, S503T, Q506K, Q513D, D521K, D521R, D521H, E523R, E523V, E523Y, E523F, E523H, E523W, and V526L.

In some embodiments, a modified polymerase comprises mutations at one or more (e.g., 1, 2, 3, 4, or 5—in any combination) positions corresponding to M429, G430, V431, I433, and A444 in Φ29 polymerase. In some embodiments, a modified polymerase of the disclosure is a modified 129 polymerase comprising a mutation at one or more positions (e.g., 1, 2, 3, 4, or 5—in any combination) of M429, G430, V431, I433, and A444. In some embodiments, amino acids at one or more (e.g., 1, 2, 3, 4, or 5—in any combination) of M429, G430, V431, I433, and A444 are changed to amino acids at corresponding positions in other polymerases (e.g., M2Y, *Lucilia cuprina*, a *Bacillus* strain, for example GA-1). In some embodiments, the modified polymerase comprises one or more (e.g., 1, 2, 3, 4, or 5—in any combination) of M429L, G430A, V431S, I433V, and A444T. In some embodiments, mutations at one or more (e.g., 1, 2, 3, 4, or 5—in any combination) positions corresponding to M429, G430, V431, I433, and A444 in Φ29 polymerase increase accuracy (e.g., in a single molecule sequencing reaction).

In some embodiments, a modified polymerase comprises mutations at one or more positions in a fingers region. For example, in some embodiments, a modified polymerase comprises mutations at one or more (e.g., 1, 2, 3, 4, 5, 6, or 7—in any combination) positions corresponding to I384, E385, N388, E391, A396, N397, and G400 in *E. faecium* polymerase. In some embodiments, a modified polymerase of the disclosure is a modified *E. faecium* polymerase comprising mutations at one or more (e.g., 1, 2, 3, 4, 5, 6, or 7—in any combination) positions corresponding to I384, E385, N388, E391, A396, N397, and G400 in *E. faecium* polymerase. In some embodiments, the mutation is selected from the group consisting of I384T, I384F, I384S, E385Y, E385K, E385R, E385N, E385Q, E385L, E385A, N388T, E391Y, E391W, E391F, E391H, E391M, E391K, E391R, A396Q, N397L, and G400L. In some embodiments, amino acids at one or more (e.g., 1, 2, 3, 4, 5, 6, or 7—in any combination) positions corresponding to I384, E385, N388, E391, A396, N397, and G400 are changed to amino acids at corresponding positions in other polymerases (e.g., Φ29, M2Y, *Lucilia cuprina*, a *Bacillus* strain, for example GA-1).

In some embodiments, a modified polymerase comprises a mutation at one or more positions in a TPR2 region. For example, in some embodiments, a modified polymerase comprises a mutation at one or more positions (e.g., 1, 2, 3, 4, or 5—in any combination) corresponding to D414, D425, R429, E436, and L437 in *E. faecium* polymerase. In some embodiments, a modified polymerase of the disclosure is a modified *E. faecium* polymerase comprising a mutation at one or more (e.g., 1, 2, 3, 4, or 5—in any combination) of D414, D425, R429, E436, and L437. In some embodiments, the mutation is selected from the group consisting of D414V, D425N, R429G, E436R, E436G, L437Y, and L437E. In some embodiments, an amino acid at the position corresponding to D414, D425, R429, E436, or L437 is changed to an amino acid at a corresponding position in other polymerases (e.g., Φ29, M2Y, *Lucilia cuprina*, a Bacillus strain, for example GA-1).

In some embodiments, a modified polymerase comprises a mutation at one or more positions in a thumb region. For example, in some embodiments, a modified polymerase comprises a mutation at one or more positions (e.g., 1, 2, 3, 4, 5, 6, 7, 8, 9, 10, 11, 12, or 13—in any combination) corresponding to D533, R534, E537, G547, E545, L555, P556, R558, T559, V564, T568, M569, and T571 in *E. faecium* polymerase. In some embodiments, a modified polymerase of the disclosure is a modified *E. faecium* polymerase comprising mutations at one or more (e.g., 1, 2, 3, 4, 5, 6, 7, 8, 9, 10, 11, 12, or 13—in any combination) of D533, R534, E537, G547, E545, L555, P556, R558, T559, V564, T568, M569, and T571. In some embodiments, a mutation is selected from the group consisting of D533A, D533Q, D533T, D533R, D533S, R534K, E537K, E537H, E537R, E545K, E545H, E545R, G547S, L555K, L555R, P556A, R558H, T559V, V564L, T568D, T568S, M569K, M569T, M569V, and T571S. In some embodiments, amino acids at one or more (e.g., 1, 2, 3, 4, 5, 6, 7, 8, 9, 10, 11, 12, or 13—in any combination) positions corresponding to D533, R534, E537, G547, E545, L555, P556, R558, T559, V564, T568, M569, and T571 are changed to amino acids at corresponding positions in other polymerases (e.g., Φ29, M2Y, *Lucilia cuprina*, a *Bacillus* strain, for example GA-1).

In some embodiments, a modified polymerase comprises mutations at one or more positions in a palm region and at one or more positions in an exonuclease region. For example, in some embodiments, a modified polymerase comprises mutations at one or more (e.g., 1, 2, or 3) positions corresponding to G197, M8, and V51 in Φ29 polymerase. In some embodiments, a modified polymerase of the disclosure is a modified Φ29 polymerase comprising mutations at one or more (e.g., 1, 2, or 3) of G197, M8, and V51. In some embodiments, the modified polymerase comprises one or more (e.g., 1, 2, or 3) of G197D, M8R, and V51A. In some embodiments, mutations at one or more (e.g., 1, 2, or 3) positions corresponding to G197, M8, and V51 in Φ29 polymerase can improve production yield, thermostability, and/or improve efficiency of loading (e.g., loading into sample wells of an array).

In some embodiments, a modified polymerase comprises mutations at one or more positions in a palm region and at one or more positions in a thumb region. For example, in some embodiments, a modified polymerase comprises mutations at one or more (e.g., 1, 2, 3, 4, or 5) positions corresponding to E466, D476, K539, D570, and T571 in Φ29 polymerase. In some embodiments, a modified polymerase of the disclosure is a modified Φ29 polymerase comprising mutations at one or more (e.g., 1, 2, 3, 4, or 5) of E466, D476, K539, D570, and T571. In some embodiments, the modified polymerase comprises one or more (e.g., 1, 2, 3, 4, or 5) of E466K, D476H, K539E, D570S, and T571V.

In some embodiments, a modified polymerase comprises one or more (e.g., 1, 2, 3, 4, 5, 6, or 7) amino acid mutations at positions corresponding to N59, Y145, V247, L250, E372, A481, and K509 in M2Y polymerase. For example, in some embodiments, where a modified polymerase comprises an M2Y polymerase majority sequence, the modified polymerase comprises one or more mutations at the positions as listed in the preceding. In some embodiments, where a modified polymerase does not comprise an M2Y polymerase majority sequence, the modified polymerase comprises one or more amino acid mutations that correspond to the positions listed above, e.g., as determined by homology alignment or other methods known in the art.

In some embodiments, a modified polymerase comprises one or more segments (e.g., domains or portions thereof, optionally including flanking amino acids) of a wild-type polymerase (e.g., as set forth in TABLE 1, e.g., SEQ ID NO: 1, SEQ ID Nos: 2-5, or SEQ ID Nos: 23-33). In some embodiments, one or more segments (e.g., domains or portions thereof, optionally including flanking amino acids) of an *Enterococcus faecium* polymerase (e.g., one or more segments of any one of SEQ ID NOs: 2-5) can be substituted for one or more segments of any one of SEQ ID NOs: 1 and 6-33. In some embodiments, one or more segments (e.g., domains or portions thereof, optionally including flanking amino acids) of an *Enterococcus faecium* polymerase (e.g., one or more segments of any one of SEQ ID NOs: 2-5) can be substituted for one or more segments of any one of SEQ ID NOs: 23-33. In some embodiments, one or more segments (e.g., domains or portions thereof, optionally including flanking amino acids) of an *Enterococcus faecium* polymerase can be substituted for one or more segments of a Φ29 polymerase. In some embodiments, one or more segments (e.g., domains or portions thereof, optionally including flanking amino acids) of an *Enterococcus faecium* polymerase can be substituted for one or more segments of an M2Y polymerase. In some embodiments, one or more segments (e.g., domains or portions thereof, optionally including flanking amino acids) of an *Enterococcus faecium* polymerase can be substituted for one or more segments of a Φ29 polymerase and/or an M2Y polymerase. In some embodiments, one or more segments (e.g., domains or portions thereof, optionally including flanking amino acids) of an *Enterococcus faecium* polymerase (e.g., a domain of any one of SEQ ID NOs: 2-5 or a modified form thereof, e.g., containing one or more amino acid substitutions) can be substituted for one or more segments of a variant polymerase described herein (e.g., of a variant polymerase listed in TABLE 3, or a variant polymerase containing one or more amino acid substitutions or other domain substitutions illustrated in TABLE 3 or described in TABLES 4-6).

(ii) Modifications of a Polymerase Domain, Subdomain, or Segment—Chimeric Polymerases FIG. 2 depicts a cartoon illustration of Φ29 polymerase 200. The folded, three-dimensional structure comprises distinct domains and subdomains corresponding to overlay 202: an N-terminal exonuclease domain (1) and a C-terminal polymerase domain that contains a palm subdomain (2), a terminal protein region 1 subdomain (TPR1) (3), a fingers subdomain (4), a TPR2 subdomain (5), and a thumb subdomain (6). These domains and subdomains map to areas of the polypeptide strand according to polypeptide construct 204, which is oriented in an N-terminal to C-terminal fashion. As shown, the N-terminal exonuclease domain (1) spans residues 1-189 and the C-terminal polymerase domain spans residues 190-575 of wild-type Φ29 polymerase. Within the C-terminal polymerase domain, the palm subdomain (2) spans residues 190-260 and 427-530, the TPR1 subdomain (3) spans residues 261-358, the fingers subdomain (4) spans residues 359-394, the TPR2 subdomain (5) spans residues 395-426, and the thumb subdomain (6) spans residues 531-575 of wild-type Φ29 polymerase. Equivalent segments (e.g., domains or portions thereof, optionally including flanking amino acids) of different polymerases described in this application can be substituted for each other to produce chimeric polymerases. For example, one or more of an exonuclease domain, a palm subdomain, a TPR1 subdomain, one or more finger subdomains, a TPR2 subdomain, and/or a thumb subdomain from one polymerase (e.g., having a wild type sequence shown in TABLE 1 or having one or more mutations exemplified in TABLEs 2-3 or described in TABLEs 4-6) can be substituted for a corresponding domain in another polymerase (e.g., having a wild type sequence shown in TABLE 1 or having one or more mutations exemplified in TABLEs 2-3 or described in TABLEs 4-6). In some embodiments, segments comprising portions of one or more of these domains, optionally including one or more flanking amino acids, can be substituted.

In some embodiment, a modification of a polymerase comprises an addition of a segment, subdomain, or domain. For example, in some embodiments, a modification comprises a duplication of a segment, subdomain, or domain of a polymerase. In some embodiment, a modification comprises an addition of a segment, subdomain, or domain of a reference polymerase (thereby producing a "chimeric polymerase" as described herein). In some embodiments, a modification of a polymerase comprises an addition of a non-native chemical entity. For example, in some embodiments, a modification of a polymerase comprises the addition of one or more histidine residues at the N-terminus of a polymerase. In some embodiments, a modification of a polymerase comprises the addition of a bis-biotin tag.

In some embodiments, a modification of a polymerase comprises a deletion of a segment, subdomain, or domain.

In some embodiments, a modification of a polymerase comprises a substitution of a segment, subdomain, or domain with a corresponding domain of a reference polymerase (thereby producing a "chimeric polymerase" as described herein, see e.g., FIG. 6). For example, one or more of an exonuclease domain, a palm subdomain, a TPR1 subdomain, one or more finger subdomains, a TPR2 subdomain, and/or a thumb subdomain from one polymerase (e.g., having a wild type sequence shown in TABLE 1 or having one or more mutations exemplified herein) can be substituted for a corresponding domain in another polymerase (e.g., having a wild type sequence shown in TABLE 1 or having one or more mutations exemplified herein). In some embodiments, segments comprising portions of one or more of these domains, optionally including one or more flanking amino acids, can be substituted.

For example, in some embodiments, a modified polymerase comprises a TPR1 region substitution. For example, in some embodiments, a modified polymerase comprises a TPR1 region from E. faecium (e.g., V271-M375 in SEQ ID NO: 5) in place of a TPR1 region corresponding to S260-L359 in Φ29 polymerase (SEQ ID NO: 1).

In some embodiments, a modified polymerase of the present application comprises one or more substitutions within an exonuclease region. For example, in some embodiments, a modified polymerase comprises a portion of an exonuclease region from M2Y (e.g., M1-I51 in SEQ ID NO: 6) in place of amino acids corresponding to M1-V54 in Φ29 polymerase (SEQ ID NO: 1). In some embodiments, a modified polymerase comprises a portion of an exonuclease region from E. faecium (e.g., F72-S89 in SEQ ID NO: 2) in place of amino acids corresponding to E75-N91 in Φ29 polymerase (SEQ ID NO: 1). In some embodiments, a modified polymerase comprises the portion of the exonuclease region from M2Y and the portion of the exonuclease region from E. faecium in place of amino acids corresponding to M1-V54 and E75-N91, respectively, in Φ29 polymerase.

In some embodiments, a modified polymerase of the present application comprises a modified palm region. For example, in some embodiments, a modified polymerase comprises a portion of a palm region from E. faecium (e.g., L445-V449 in SEQ ID NO: 2) in place of amino acids corresponding to M429-I433 in Φ29 polymerase (SEQ ID NO: 1). In some embodiments, a modified polymerase comprises an alanine to thymine mutation at a position corresponding to A444 in Φ29 polymerase (e.g., A444T). In some embodiments, a modified polymerase comprises the portion of the palm region from E. faecium and an amino acid mutation corresponding to A444T in Φ29 polymerase.

In some embodiments, a modified polymerase comprises a majority polymerase sequence other than Φ29 polymerase. In such embodiments, the majority polymerase sequence comprises one or more regions that may be analogized to Φ29 polymerase 200 (e.g., based on homology alignment, computational modeling, structural analysis, or any suitable method). As used herein, a "region" of a polymerase refers to a distinct domain or subdomain of a polymerase enzyme. For example, in some embodiments, a region of a polymerase refers to an N-terminal exonuclease domain or a C-terminal polymerase domain. In some embodiments, a region of a polymerase refers to a palm subdomain, a TPR1 subdomain, a fingers subdomain, a TPR2 subdomain, or a thumb subdomain. Accordingly, in some embodiments, a region of a polymerase refers to all amino acids that comprise a given domain or subdomain. In some embodiments, a modified polymerase comprises modifications to one or more regions of a majority polymerase sequence. In some embodiments, a modified polymerase comprises modifications to one or more portions of a majority polymerase sequence. As used herein, a "portion" of a polymerase refers to a stretch of two or more consecutive residues within the polymerase sequence. In some embodiments, a portion of a polymerase sequence refers to two or more consecutive amino acids in a single polymerase domain or a single polymerase subdomain. In some embodiments, a portion of a polymerase sequence refers to two or more consecutive amino acids spanning more than one polymerase domain and/or subdomain. Thus, in some embodiments, a portion of a polymerase sequence is any stretch of consecutive amino acids within the polymerase sequence. In some embodiments, a portion refers to 5-10 consecutive amino acids, 10-25 consecutive amino acids, 25-50 consecutive amino acids, 50-75 consecutive amino acids, 75-100 consecutive amino acids or other number of consecutive amino acids that constitute a portion of, for example, a polymerase region or domain.

In some embodiments, a modified polymerase comprises one or more single-site mutations in one or more of the domains and/or subdomains as generally depicted in FIG. 2. For example, FIG. 3 depicts selected mutational variants of TABLE 3 with sites of mutation (shown approximated with arrows) within each polypeptide strand. Polypeptide strands are shown for M2Y and M2Y mutational variant H016, Lucilia cuprina and Lucilia cuprina mutational variant H018, Enterococcus faecium and Enterococcus faecium mutational variant H020, and Bacillus phage VMY22 and Bacillus phage VMY22 mutational variant H022. However, chimeras comprising other segment swaps and/or amino acid mutations as described herein also can be used.

In some embodiments, in addition or alternative to the one or more single-site mutational modifications described herein, a stretch of amino acids (e.g., two or more consecutive amino acids) in a majority polymerase sequence are modified. In some embodiments, the stretch of amino acids is a stretch of amino acids corresponding to a portion of a different polymerase sequence. For example, in some embodiments, a domain/subdomain (or a portion therein) of a majority polymerase sequence is swapped with a corresponding domain/subdomain (or portion therein) of a different polymerase sequence. In such embodiments, the polymerase is referred to as a chimeric polymerase, chimeric polymerase variant, or a chimera. Chimeric polymerases were engineered in accordance with embodiments described herein and are listed in TABLE 4.

In some embodiments, a modified recombinant polymerase enzyme of the disclosure is selected from TABLE 4. In some embodiments, a chimeric polymerase variant (e.g., as listed in TABLE 4) comprises a majority polymerase sequence having a region or portion of the majority sequence substituted with a corresponding region or portion of a different polymerase sequence. In some embodiments, all of the residues that comprise a region (e.g., domain and/or subdomain) in a majority polymerase sequence are substituted with all of the residues that comprise a corresponding region in a different polymerase sequence. In some embodiments, at least a portion of the residues that comprise a region in a majority polymerase sequence are substituted with at least a portion of the residues that comprise a corresponding region in a different polymerase sequence.

In some embodiments, only a single subdomain in a majority sequence is substituted with a corresponding subdomain of a different sequence. For example, FIG. 4 depicts chimeric polymerase variants selected from TABLE 4. The six selected variants are shown as polypeptide strands with subdomains as they generally occur within a polypeptide in an amino-terminal to carboxy-terminal orientation. Each of the polypeptide strands of FIG. 4 comprise a polymerase majority sequence of Q001 (hatched fill), with one or more domains and/or subdomains substituted with one or more corresponding domains and/or subdomains of M2Y polymerase (SEQ ID NO: 6, open fill) or one or more corresponding domains and/or subdomains of *Lucilia cuprina* (SEQ ID NO: 7, stippled fill) and or one or more flanking amino acids.

In some embodiments, a chimeric polymerase variant comprises a majority polymerase sequence having an exonuclease domain substituted from a different polymerase sequence. As shown in FIG. 4, C017 is a chimeric polymerase variant that comprises an exonuclease domain substituted from an M2Y polymerase sequence (e.g., as set forth in SEQ ID NO: 6). Similarly, C020 comprises an exonuclease domain substituted from a *Lucilia cuprina* polymerase sequence (e.g., as set forth in SEQ ID NO: 7). In some embodiments, modification or replacement of an exonuclease domain in a modified polymerase variant may be useful where proofreading capabilities of the polymerase are not desirable (e.g., in sequencing reactions). However, it should be appreciated that additional and alternative domain and/or subdomain substitutions are contemplated for the modified recombinant polymerases of the disclosure.

In some embodiments, a chimeric polymerase variant comprises a majority polymerase sequence having an exonuclease loop substituted from a different polymerase sequence. As used herein, in some embodiments, an "exonuclease loop" refers to a stretch of consecutive amino acids that forms a loop region in an exonuclease domain. For example, FIG. 5A depicts a cartoon illustration of Φ29 polymerase in full perspective 500 and zoomed perspective 502. Zoomed perspective 502, a close-up view of the boxed area shown in full perspective 500, shows a loop region in the exonuclease domain of Φ29 polymerase. Selected loop residues are shown in stick form in zoomed perspective 502, with the stretch of consecutive amino acids that form the exonuclease loop spanning residues N77 through N88. Evolutionary conservation analysis of this region of the exonuclease domain revealed that the loop, and several flanking residues, is relatively poorly conserved. FIG. 5B depicts a homology alignment 504 between exonuclease regions of Φ29 polymerase and a non-limiting set of other polymerases selected from TABLE 1. Also depicted is a loop homology alignment 506 showing exonuclease loop N77-N88 of Φ29 polymerase and the corresponding exonuclease loop in other polymerases.

Based on the homology analysis showing relatively low conservation in regions corresponding to exonuclease loop N77-N88 of Φ29 polymerase, this provided a source of variation in the search for desirable biochemical properties in a polymerase variant (e.g., desirable for use in sequencing reactions). Accordingly, in some embodiments, a chimeric polymerase variant comprises a majority polymerase sequence having an exonuclease loop substituted from a different polymerase sequence, where an "exonuclease loop" is homologous to exonuclease loop N77-N88 of Φ29 polymerase (e.g., as shown by loop homology alignment 506 in FIG. 5B).

As shown by the example alignment in FIG. 5B, sequence homology analysis can be used to identify an exonuclease loop sequence that is homologous to N77-N88 of Φ29 polymerase. By way of example and not limitation, the loop homology alignment 506 shows homologous exonuclease loop sequences for M2Y (H74-N85), *Lucilia cuprina* (N64-G76), *E. faecium* (N74-R86), Bacillus GA-1 (N74-K88), *Bacillus* VMY22 (K80-K91), *Actinomyces* AV-1 (H93-K105), Potato cyst nematode (L86-K99), Iberian lynx gut (D73-R87), *Candidatus* (N85-N98), and *Eggerthella* sp. (V73-K88). Accordingly, in some embodiments, a substituted exonuclease loop can include between around 12 and around 16 amino acids in a region of homology to N77-N88 of Φ29 polymerase. In some embodiments, a substituted exonuclease loop comprises between around 10 amino acids and up to 20 amino acids, between around 5 amino acids and up to 15 amino acids, between around 5 amino acids and up to 20 amino acids, or between around 5 amino acids and 25 amino acids or more, in a region of homology to N77-N88 of Φ29 polymerase.

In some embodiments, a modified polymerase of the present application comprises one or more amino acid mutations in a region of an exonuclease domain that includes an exonuclease loop of homology to N77-N88 of Φ29 polymerase. For example, in some embodiments, a modified polymerase of the disclosure is a modified Φ29 polymerase comprising mutations at one or more of E75, R76, S82, A83, D84, G85, L86, P87, N88, Y90, and N91 in Φ29 polymerase. In some embodiments, the modified polymerase comprises one or more of E75F, R76K, S82C, A83K, D84E, G85A, L86K, P87E, N88R, Y90F, and N91S. In some embodiments, a modified polymerase comprises one or more amino acid mutations at positions corresponding to E75, R76, S82, A83, D84, G85, L86, P87, N88, Y90, and N91 in Φ29 polymerase. For example, in some embodiments, where a modified polymerase does not comprise a Φ29 polymerase majority sequence, the modified polymerase comprises one or more amino acids that correspond to the positions listed above, e.g., as determined by homology alignment or other methods known in the art.

In some embodiments, a chimeric polymerase variant comprises a majority polymerase sequence having a TPR1 subdomain substituted from a different polymerase sequence. For example, C018 is a chimeric polymerase that comprises a TPR1 subdomain substituted from an M2Y polymerase sequence. Similarly, C021 comprises a TPR1 subdomain substituted from a *Lucilia cuprina* polymerase. In some embodiments, a chimeric polymerase variant comprises a majority polymerase sequence having a palm subdomain substituted from a different polymerase sequence. In some embodiments, a chimeric polymerase variant comprises a majority polymerase sequence having a fingers subdomain substituted from a different polymerase sequence. In some embodiments, a chimeric polymerase variant comprises a majority polymerase sequence having a TPR2 subdomain substituted from a different polymerase sequence. In some embodiments, a chimeric polymerase variant comprises a majority polymerase sequence having a thumb subdomain substituted from a different polymerase sequence. As described herein, modified recombinant polymerases include chimeric polymerase variants comprising more than one domain and/or subdomain substitution.

In some embodiments, two regions (e.g., domains/subdomains) in a majority sequence are substituted with two corresponding regions (e.g., corresponding domains/subdomains) of a different sequence. For example, as shown in FIG. 4, C019 is a chimeric polymerase that comprises an exonuclease domain and TPR1 subdomain substituted with corresponding exonuclease domain and TPR1 subdomain of an M2Y polymerase sequence. Similarly, C022 comprises exonuclease domain and TPR1 subdomain substituted with corresponding exonuclease domain and TPR1 subdomain of a *Lucilia cuprina* polymerase. In some embodiments, additional domain and/or subdomain substitutions are contemplated with the modified polymerases described herein. For example, in some embodiments, more than two (e.g., three, four, five, or six) regions (e.g., domains/subdomains) in a majority sequence are substituted with more than two (e.g., three, four, five, or six) corresponding regions of a different sequence.

In some embodiments, a majority polymerase sequence of a chimeric polymerase variant is selected from a sequence in TABLEs 1-4. In some embodiments, a majority polymerase sequence of a chimeric polymerase variant is selected from SEQ ID Nos: 2-5, or SEQ ID Nos: 23-33. In some embodiments, the majority polymerase sequence comprises one or more regions and/or portions substituted from a different polymerase sequence selected from TABLEs 1-4. For example, TABLE 5 provides an overview of selected chimeric polymerase variants from TABLE 4 and lists a majority polymerase sequence for each along with a description of the substituted region(s)/portion(s) and the sequence from which the substitution was based.

However, other chimeras, for example as described and illustrated in one or more of the Tables herein can be used and/or further modified.

In some embodiments, a chimeric polymerase variant may further comprise one or more site-specific mutations. Thus, in some embodiments, any of the one or more mutations described herein (e.g., any of the one or more mutations included in each sequence in Tables 2-3) may be applied to any of the chimeric polymerases contemplated in the present disclosure (e.g., as described in the above and listed in TABLE 4). FIG. 6 generally depicts chimeric polymerase variants comprising one or more mutations. For example, mutant chimeric polymerase 602 comprises a Φ29 polymerase majority sequence having a substituted M2Y exonuclease domain and mutations within the substituted domain. In some embodiments, a mutant chimeric polymerase comprises a majority sequence with two or more regions substituted with regions corresponding to two or more different polymerase sequences. For example, mutant chimeric polymerase 604 comprises a Φ29 polymerase majority sequence having a substituted *Enterococcus faecium* polymerase TPR1 subdomain and a substituted M2Y polymerase TPR2 subdomain, with site-specific mutations made at various positions in the polymerase sequence. In some embodiments, a mutant chimeric polymerase comprises a majority sequence with two or more regions substituted with regions corresponding to a different polymerase. For example, mutant chimeric polymerase 606 comprises a Φ29 polymerase majority sequence having substituted *Enterococcus faecium* polymerase TPR1, TPR2, and thumb subdomains, with site-specific mutations made at various positions in the polymerase sequence TABLE 6 provides an overview of selected chimeric polymerase variants from TABLE 4, which provides a majority polymerase sequence for each along with a description of the amino acid mutations made to the particular variant.

However, other amino acid mutations can be incorporated into one or more chimeric polymerases described herein. For example, one or more amino acids changes can be incorporated at one or more of positions M8, V51, N62, I71, L107, and/or K131, and/or at one or more of positions K135, L142, G197, Y224, E239, V250, L253, Y281, I288, T301, R306, R308, D325, D341, K354, T368, E375, A437, A444, E466, D476, A484, E508, D510, K512, E515, K539, D570, and T571 with reference to the Φ29 polymerase sequence. For example, in some embodiments, a chimeric polymerase also may include one or more of the following amino acid substitutions: M8R, V51A, N62D, I71V, L107I, and/or K131E, and/or one or more of the following amino acid substitutions: K135Q, L142K, G197D, Y224K, E239G, V250A, V250I, L253A, L253H, Y281H, I288L, T301C, R306Q, R308L, D325E, D341E, K354R, T368F, E375Y, A437G, A444T, E466K, D476H, A484E, E508R, D510K, D510R, K512Y, E515Q, K539E, D570S, and/or T571V.

In other embodiments, one or more amino acids changes can be incorporated at one or more of positions K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, and/or T571 with reference to *E. faecium* polymerase (SEQ ID NO: 2). In some embodiments, a chimeric polymerase also may include one or more of the following amino acid substitutions: K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, N145H, N145R, P147Q, P147T, I148K, I148H, I148R, E152D, I153V, P160A, D167P, D167K, D167H, D167R, D171K, D171H, D171R, N175T, N175Y, F188C, D189K, D189H, D189R, Q206K, Q206R, Q206H, T211A, S216G, S216R, R217G, D232K, A236G, V247D, I253H, I253A, V261A, V261I, V261L, L264H, L264A, L264M, S267A, P273S, P273R, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, D374Q, D374H, I384T, I384F, I384S, E385Y, E385K, E385R, E385N, E385Q, E385L, E385A, N388T, E391Y, E391W, E391F, E391H, E391M, E391K, E391R, A396Q, N397L, G400L, D414V, D425N, R429G, E436R, E436G, L437Y, L437E, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S502A, S503T, Q506K, Q513D, D521K, D521R, D521H, E523R, E523V, E523Y, E523F, E523H, E523W, V526L, D533A, D533Q, D533T, D533R, D533S, R534K, E537K, E537H, E537R, E545K, E545H, E545R, G547S, L555K, L555R, P556A, R558H, T559V, V564L, T568D, T568S, M569K, M569T, M569V, and/or T571S.

TABLE 2

*E. faecium* polymerase variants

| Name | SEQ ID NO: | Sequence |
|---|---|---|
| EFM0 | 34 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM36 | 35 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM37 | 36 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM38 | 37 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM39 | 38 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM40 | 39 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD |

TABLE 2-continued

*E. faecium* polymerase variants

| Name | SEQ ID NO: | Sequence |
|---|---|---|
| | | QGLTRMTRGSDALGDYQDWVKTTYGKSRFKQWFPVLSLGFDKDLRKAYKGGFTWVNKVFQGKE<br>IGEGIVFDVNSAYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM41 | 40 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDINSAYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM42 | 41 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSAYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM43 | 42 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDINSAYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM44 | 43 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM45 | 44 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM46 | 45 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |

TABLE 2-continued

*E. faecium* polymerase variants

| Name | SEQ ID NO: | Sequence |
|---|---|---|
| EFM47 | 46 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSAYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM48 | 47 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM49 | 48 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDINSAYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM50 | 49 | MIKRYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM51 | 50 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKKLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM52 | 51 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRDKTYVEEIDGELNVKCAGMPDRIKELVTFDNFEVGFSSYGKLLPKRTQGGVVLVD<br>TMFTIK |
| EFM53 | 52 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST |

TABLE 2-continued

E. faecium polymerase variants

| Name | SEQ ID NO: | Sequence |
|---|---|---|
| | | FQRAKFIRQKTYVEEIDGELNVKCAGMPDRIKELVTFDNFEVGFSSYGKLLPKRTQGGVVLVD<br>TMFTIK |
| EFM54 | 53 | MIKKYTGDFETTTDLNDCRVWSWGVCDIDNVDNITFGLEIDSFFEWCEMQGSTDIYFHDLKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM55 | 54 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELITLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM56 | 55 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM57 | 56 | MIKKYTGDFETTTDLNDCRVWAWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM58 | 57 | MIKKYTGDFETTTDLNDCRVWSWGVCDIDNVDNITFGLEIDSFFEWCEMQGSTDIYFHDEKFD<br>GEFMLSWLFKNGFKWCKEAKEPRTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM59 | 58 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKATYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM60 | 59 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWGVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV |

TABLE 2-continued

E. faecium polymerase variants

| Name | SEQ ID NO: | Sequence |
|---|---|---|
| | | KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM61 | 60 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM62 | 61 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLVGTEVPEAIEHLVDSKKLGYWKHEST<br>FQRAKFIRQKTYVEEIDGELNVKCAGMPDRIKELVTFDNFEVGFSSYGKLLPKRTQGGVVLVD<br>TMFTIK |
| EFM63 | 62 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDPKKLGYWKHEST<br>FQRAKFIRQKTYVEEIDGELNVKCAGMPDRIKELVTFDNFEVGFSSYGKLLPKRTQGGVVLVD<br>TMFTIK |
| EFM64 | 63 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKKIAKAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWKHEST<br>FQRAKFIRQKTYVEEIKGELNVKCAGMPDRIKELVTFDNFEVGFSSYGKLLPKRTQGGVVLVD<br>TMFTIK |
| EFM65 | 64 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWKHEST<br>FQRAKFIRQKTYVEEIDGKLNVKCAGMPDRIKELVTFDNFEVGFSSYGKLLPKRTQGGVVLVD<br>TMFTIK |
| EFM66 | 65 | MIKKYTGDFETTTDLNDCRVWAWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKERHIPTIQV<br>KQSSLFIQNEYLESSVNKLGVGELITLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWKHEST<br>FQRAKFIRQKTYVEEIDGKLNVKCAGMPDRIKELVTFDNFEVGFSSYGKLLPKRTQGGVVLVD<br>TMFTIK |
| EFM67 | 66 | MIKRYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII |

TABLE 2-continued

_E. faecium polymerase variants_

| Name | SEQ ID NO: | Sequence |
|---|---|---|
| | | YDSLKKYPFPVKKIAKAFNFPIKKGEIDYTKERPIGYNPTDDEWDYLKNDIQIMAMALKIQFD<br>QGLTRMTRGSDALGDYQDWVKTTYGKSRFKQWFPVLSLGFDKKLRKAYKGGFTWVNKVFQGKE<br>IGEGIVFDANSHYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRDKTYVEEIKGELNVKCAGMPDRIKELVTFDNFEVGFSSYGKLLPKRTQGGVVLVD<br>TMFTIK |
| EFM68 | 67 | MIKRYTGDFETTTDLNDCRVWSWGVCDIDNVDNITFGLEIDSFFEWCEMQGSTDIYFHDLKFD<br>GEFMLSWLFKNGFKWCKEAKEERTFSTLISNMGQWYALEICWNVKCTTTKTGKTKKEKQRTII<br>YDSLKKYPFPVKKIAKAFNFPIKKGEIDYTKERPIGYNPTDDEWDYLKNDIQIMAMALKIQFD<br>QGLTRMTRGSDALGDYQDWVKTTYGKSRFKQWFPVLSLGFDKKLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRDKTYVEEIKGELNVKCAGMPDRIKELVTFDNFEVGFSSYGKLLPKRTQGGVVLVD<br>TMFTIK |
| EFM69 | 68 | MIKRYTGDFETTTDLNDCRVWAWGVCDIDNVDNITFGLEIDSFFEWCEMQGSTDIYFHDLKFD<br>GEFMLSWLFKNGFKWCKEAKEPRTFSTLISNMGQWYALEICWGVKCTTTKTGKTKKEKVRTII<br>YDSLKKYPFPVKQIAKAFNFPKKKGEIDYTKERPIGYNPTDDEWDYLKNDIQIMAMALKIQFD<br>QGLTRMTRGSDALGDYQDWVKATYGKSRFKQWFPVLSLGFDKDLRKAYKGGFTWVNKVFQGKE<br>IGEGIVFDINSAYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLVGTKVPEAIEHLVHPKKLGYWEHEST<br>FQRAKFIRDKTYVEEIKGKLNVKCAGMPDRIKELVTFDNFEVGFSSYGKLLPKRTQGGVVLVD<br>TMFTIK |
| EFM70 | 69 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM71 | 70 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM72 | 71 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM73 | 72 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPIKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVDSKKLGYWEHEST<br>FQRAKFIRQKTYVEEIDGELNVKCAGMPDRIKELVTFDNFEVGFSSYGKLLPKRTQGGVVLVD<br>TMFTIK |

TABLE 2-continued

*E. faecium* polymerase variants

| Name | SEQ ID NO: | Sequence |
|---|---|---|
| EFM74 | 73 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM75 | 74 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM76 | 75 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM77 | 76 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM78 | 77 | MIKKYTGDFETTTDLNDCRVWAWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVGELITLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM79 | 78 | MIKKYTGDFETTTDLNDCRVWAWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVGELITLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM80 | 79 | MIKKYTGDFETTTDLNDCRVWAWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVGELITLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV |

TABLE 2-continued

*E. faecium* polymerase variants

| Name | SEQ ID NO: | Sequence |
|------|------------|----------|
| | | YVPLASFVTAWGRYTTITTAQRCFDNIIYCDTDSIHLTGTKVPEAIEHLVHSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM81 | 80 | MIKKYTGDFETTTDLNDCRVWAWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVGELITLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM82 | 81 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM83 | 82 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM84 | 83 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGELNVKCAGMPDRIKELVTFDNFEVGFSSYGKLLPKRTQGGVVLVD<br>TMFTIK |
| EFM85 | 84 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWDYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTEGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM86 | 85 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWKYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM87 | 86 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKKIAEAFNFPKKKGEIDYTKERPIGYNPTDDEWKYLKNDIQIMAMALKIQFK<br>QGLTRMTRGSDALGDYQDWVKTTYGKSRFKQWFPVLSLGFDKDLRKAYKGGFTWVNKVFQGKE |

TABLE 2-continued

E. faecium polymerase variants

| Name | SEQ ID NO: | Sequence |
|---|---|---|
| | | IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGKLNVKCAGMPDRIKKLVTFDNFEVGFSSYGKLLPKRTQGGVVLVD<br>TMFTIK |
| EFM88 | 87 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKKIAEAFNFPKKKGEIDYTKERPIGYNPTDDEWKYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMPKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM89 | 88 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWKYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM90 | 89 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAEAFNFPKKKGEIDYTKERPIGYNPTDDEWKYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGKLNVKCAGMPDRIKKLVTFDNFEVGFSSYGKLLPKRTQGGVVLVD<br>TMFTIK |
| EFM91 | 90 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWKYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM92 | 91 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWKYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM93 | 92 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKKIAEAFNFPKKKGEIDYTKERPIGYNPTDDEWKYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |

TABLE 2-continued

E. faecium polymerase variants

| Name | SEQ ID NO: | Sequence |
|---|---|---|
| EFM94 | 93 | MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTPDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIDGKLNVKCAGMPDRIKKLVTFDNFEVGFSSYGKLLPKRTQGGVVLVD
TMFTIK |
| EFM95 | 94 | MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAEAFNFPKKKGEIDYTKERPIGYNPTPDEWKYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKELVTFDNFEVGFSSYGKLLPKRTQGGVVLVD
TMFTIK |
| EFM96 | 95 | MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAEAFNFPIKKGEIDYTKERPIGYNPTDDEWDYLKNDIQIMAMALKIQFD
QGLTRMTRGSDALGDYQDWVKTTYGKSRFKQWFPVLSLGFDKDLRKAYKGGFTWVNKVFQGKE
IGEGIVFDANSHYPSQMYVRLLPYGEPIVFEGKYVWDEDYPLHIQHIRCEFELKEGYIPTIQI
KRSRFYKGNEYLKSSGGEIADLWLSNVDLELMKEHYDLYNVEYISGLKFKATTDMFKGWIDKW
IEVKNTTEGARKANAKGMLNSLYGKFGTNPDITGKVPYMGEDGIVRLTLGEEELRDPVYVPLA
SFVTAWGRYTTITTAQRCFDNIIYCDTDSIHLTGTEVPEAIEHLVDSKKLGYWEHESTFQRAK
FIRQKTYVEEIDGELNVKCAGMPDRIKELVTFDNFEVGFSSYGKLLPKRTQGGVVLVDTMFTI
K |
| EFM97 | 96 | MHHHHHHHHHHDYDIPTTENLYFQGMIKKYTGDFETTTDLNDCRVWSWGVCDIDNVDNITFGL
EIDSFFEWCEMQGSTDIYFHNEKFDGEFMLSWLFKNGFKWCKEAKEERTFSTLISNMGQWYAL
EICWNVKCTTTKTGKTKKEKQRTIIYDSLKKYPFPVKEIAEAFNFPIKKGEIDYTKERPIGYN
PTDDEWDYLKNDIQIMAMALKIQFDQGLTRMTRGSDALGDYQDWVKTTYGKSRFKQWFPVLSL
GFDKDLRKAYKGGFTWVNKVFQGKEIGEGIVFDVNSLYPSQMYVRPLPYGTPLFYEGEYKENI
DYPLYIQNIKVRFRLKERHIPTIQVKQSSLFIQNEYLESSVNKLGVDELIDLTLTNVDLDLFF
EHYDILEIHYTYGYMFKASCDMFKGWIDKWIEVKNTTEGARKANAKGMLNSLYGKFGTNPDIT
GKVPYMGEDGIVRLTLGEEELRDPVYVPLASFVTAWGRYTTITTAQRCFDNIIYCDTDSIHLT
GTEVPEAIEHLVDSKKLGYWKHESTFQRAKFIRQKTYVEEIDGELNVKCAGMPDRIKELVTFD
NFEVGFSSYGKLLPKRTQGGVVLVDTMFTIK |
| EFM98 | 97 | MHHHHHHHHHHDYDIPTTENLYFQGMIKKYTGDFETTTDLNDCRVWSWGVCDIDNVDNITFGL
EIDSFFEWCEMQGSTDIYFHDEKFDGEFMLSWLFKNGFKWCKEAKEERTFSTLISNMGQWYAL
EICWNVKCTTTKTGKTKKEKQRTIIYDSLKKYPFPVKEIAEAFNFPIKKGEIDYTKERPIGYN
PTDDEWDYLKNDIQIMAMALKIQFDQGLTRMTRGSDALGDYQDWVKTTYGKSRFKQWFPVLSL
GFDKDLRKAYKGGFTWVNKVFQGKEIGEGIVFDVNSLYPSQMYVRPLPYGTPLFYEGEYKENI
DYPLYIQNIKVRFRLKERHIPTIQVKQSSLFIQNEYLESSVNKLGVDELIDLTLTNVDLDLFF
EHYDILEIHYTYGYMFKASCDMFKGWIDKWIEVKNTTEGARKANAKGMLNSLYGKFGTNPDIT
GKVPYMGEDGIVRLTLGEEELRDPVYVPLASFVTAWGRYTTITTAQRCFDNIIYCDTDSIHLT
GTEVPEAIEHLVDSKKLGYWKHESTFQRAKFIRQKTYVEEIDGELNVKCAGMPDRIKELVTFD
NFEVGFSSYGKLLPKRTQGGVVLVDTMFTIK |
| EFM99 | 98 | MHHHHHHHHHHDYDIPTTENLYFQGMIKKYTGDFETTTDLNDCRVWSWGVCDIDNVDNITFGL
EIDSFFEWCEMQGSTDIYFHDEKFDGEFMLSWLFKNGFKWCKEAKEERTFSTLISNMGQWYAL
EICWNVKCTTTKTGKTKKEKQRTIIYDSLKKYPFPVKEIAEAFNFPIKKGEIDYTKERPIGYN
PTDDEWDYLKNDIQIMAMALKIQFDQGLTRMTRGSDALGDYQDWVKTTYGKSRFKQWFPVLSL
GFDKDLRKAYKGGFTWVNKVFQGKEIGEGIVFDANSHYPSQMYVRPLPYGTPLFYEGEYKENI
DYPLYIQNIKVRFRLKERHIPTIQVKQSSLFIQNEYLESSVNKLGVDELIDLTLTNVDLDLFF
EHYDILEIHYTYGYMFKASCDMFKGWIDKWIEVKNTTEGARKANAKGMLNSLYGKFGTNPDIT
GKVPYMGEDGIVRLTLGEEELRDPVYVPLASFVTAWGRYTTITTAQRCFDNIIYCDTDSIHLT
GTEVPEAIEHLVDSKKLGYWEHESTFQRAKFIRQKTYVEEIDGELNVKCAGMPDRIKELVTFD
NFEVGFSSYGKLLPKRTQGGVVLVDTMFTIK |
| EFM100 | 99 | MHHHHHHHHHHDYDIPTTENLYFQGMIKKYTGDFETTTDLNDCRVWSWGVCDIDNVDNITFGL
EIDSFFEWCEMQGSTDIYFHDEKFDGEFMLSWLFKNGFKWCKEAKEERTFSTLISNMGQWYAL
EICWNVKCTTTKTGKTKKEKQRTIIYDSLKKYPFPVKEIAEAFNFPIKKGEIDYTKERPIGYN
PTDDEWDYLKNDIQIMAMALKIQFDQGLTRMTRGSDALGDYQDWVKTTYGKSRFKQWFPVLSL
GFDKDLRKAYKGGFTWVNKVFQGKEIGEGIVFDANSHYPSQMYVRPLPYGTPLFYEGEYKENI
DYPLYIQNIKVRFRLKERHIPTIQVKQSSLFIQNEYLESSVNKLGVDELIDLTLTNVDLDLFF
EHYDILEIHYTYGYMFKASCDMFKGWIDKWFEVKNTTYGARKANAKGMLNSLYGKFGTNPDIT |

TABLE 2-continued

*E. faecium* polymerase variants

| Name | SEQ ID NO: | Sequence |
|---|---|---|
| | | GKVPYMGEDGIVRLTLGEEELRDPVYVPLASFVTAWGRYTTITTAQRCFDNIIYCDTDSIHLT<br>GTEVPEAIEHLVDSKKLGYWKHESTFQRAKFIRQKTYVEEIDGELNVKCAGMPDRIKELVTFD<br>NFEVGFSSYGKLLPKRTQGGVVLVDTMFTIK |
| EFM101 | 100 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKKIAEAFNFPKKKGEIDYTKERPIGYNPTDDEWYLKNDIQIMAMALKIQFD<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM102 | 101 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM103 | 102 | MIKKYTGDFETTTDLNDCRVWSWGVCDIDNVDNITFGLEIDSFFEWCEMQGSTDIYFHDEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGKLNVKCAGMPDRIKKLVTFDNFEVGFSSYGKLLPKRTQGGVVLVD<br>TMFTIK |
| EFM104 | 103 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFTVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM105 | 104 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM106 | 105 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDKLIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM107 | 106 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE |

TABLE 2-continued

E. faecium polymerase variants

| Name | SEQ ID NO: | Sequence |
|---|---|---|
| | | IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMPKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGVLNVKCAGMPDRIKKLVTFDNFEVGFSSYGKLLPKRTQGGVVLVD<br>TMFTIK |
| EFM108 | 107 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFTVKEIAKAFNFPKKKGEIDYTKERPIGYNPTDDEWKYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMPKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM109 | 108 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWKYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM110 | 109 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWKYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDKLIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKELVTFDNFEVGFSSYGKLLPKRTQGGVVLVD<br>TMFTIK |
| EFM111 | 110 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWKYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGVLNVKCAGMPDRIKELVTFDNFEVGFSSYGKLLPKRTQGGVVLVD<br>TMFTIK |
| EFM112 | 111 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM113 | 112 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |

TABLE 2-continued

*E. faecium* polymerase variants

| Name | SEQ ID NO: | Sequence |
|---|---|---|
| EFM114 | 113 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM115 | 114 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDINSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM116 | 115 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM117 | 116 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSAYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM118 | 117 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDINSAYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM119 | 118 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSMYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM120 | 119 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSMYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV |

TABLE 2-continued

E. faecium polymerase variants

| Name | SEQ ID NO: | Sequence |
|---|---|---|

YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIK

EFM121 120 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSMYPSQMYVRPLPYGTPLFYEGEYKENIDYPLYIQNIKVRFRLKEGHIPTIQV
KQSSMFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIK

EFM122 121 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSLYPSQMYVRPLPYGTPLFYEGEYKENIDYPLYIQNIKVRFRLKEGHIPTIQV
KQSSMFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIK

EFM123 122 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDVNSLYPSQMYVRPLPYGTPLFYEGEYKENIDYPLYIQNIKVRFRLKEGHIPTIQV
KQSSMFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIK

EFM124 123 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSLYPSQMYVRPLPYGTPLFYEGEYKENIDYPLYIQNIKVRFRLKEGHIPTIQV
KQSSMFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIK

EFM125 124 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEDIYAKRVRGYLIECSPDEATTTKLNVKCAGMPDRIKKLVTFDNFEVGFS
SYGKLLPKRTQGGVVLVDTMFTIK

EFM126 125 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEDIYMKRVRGYLVQGSPDDYTDIKLNVKCAGMPDRIKKLVTFDNFEVGFS
SYGKLLPKRTQGGVVLVDTMFTIK

EFM127 126 MIKKYTGDFETTTDLNDCRVWAWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE

TABLE 2-continued

E. faecium polymerase variants

| Name | SEQ ID NO: | Sequence |
|---|---|---|
| | | IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM128 | 127 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELITLTLTNVDLDLFFEHYDILEIHYTYGYMFKASCDMPKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM129 | 128 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM130 | 129 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM131 | 130 | MIKKYTGDFETTTDLNDCRVWSWGVCDIDNVDNITFGLEIDSFFEWCEMQGSTDIYFHNEKFD<br>GEFMLSWLFKNGFKWCKEAKEPRTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM132 | 131 | MIKKYTGDFETTTDLNDCRVWAWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELITLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM133 | 132 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWKHEST<br>FQRAKFIRQKTYVEEIKGKLNVKCAGMPDRIKKLVTFDNFEVGFSSYGKLLPKRTQGGVVLVD<br>TMFTIK |

TABLE 2-continued

E. faecium polymerase variants

| Name | SEQ ID NO: | Sequence |
|---|---|---|
| EFM134 | 133 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKERHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM135 | 134 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPIKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM136 | 135 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM137 | 136 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM138 | 137 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGKLNVKCAGMPDRIKKLVTFDNFEVGFSSYGKLLPKRTQGGVVLVD<br>TMFTIK |
| EFM139 | 138 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM140 | 139 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV |

TABLE 2-continued

E. faecium polymerase variants

| Name | SEQ ID NO: | Sequence |
|---|---|---|
| | | YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIK |
| EFM141 | 140 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM142 | 141 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIK |
| EFM143 | 142 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM144 | 143 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSMFIQNEYLESSVNKLGVDELIDLTLTNVDLDLFFEHYDILEIHYTYGYMFKASCDMFKG<br>WIDKWSEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIK |
| EFM145 | 144 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDINSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGSGGGSGGGSGLNDFFEAQKIEWHE |
| EFM146 | 145 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSAYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGSGGGSGGGSGLNDFFEAQKIEWHE |
| EFM147 | 146 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE |

TABLE 2-continued

E. faecium polymerase variants

| Name | SEQ ID NO: | Sequence |
|---|---|---|

IGEGIVFDVNSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHE

EFM148 147 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHE

EFM149 148 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSMYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHE

EFM150 149 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDVNSMYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHE

EFM151 150 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSMYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHE

EFM152 151 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSLYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHE

EFM153 152 MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDVNSLYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHE

TABLE 2-continued

E. faecium polymerase variants

| Name | SEQ ID NO: | Sequence |
|---|---|---|
| EFM154 | 153 | MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSLYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHE |
| EFM155 | 154 | MIKKYTGDFETTTDLNDCRVWAWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHE |
| EFM156 | 155 | MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHE |
| EFM157 | 156 | MIKKYTGDFETTTDLNDCRVWSWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHE |
| EFM158 | 157 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHE |
| EFM159 | 158 | MIKKYTGDFETTTDLNDCRVWSWGVCDIDNVDNITFGLEIDSFFEWCEMQGSTDIYFHNEKFD
GEFMLSWLFKNGFKWCKEAKEPRTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHE |
| EFM160 | 159 | MIKKYTGDFETTTDLNDCRVWAWGVCDIDNVDNITFGLEIDSFFEWCEMQGSTDIYFHNEKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVELITLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV |

TABLE 2-continued

E. faecium polymerase variants

| Name | SEQ ID NO: | Sequence |
|---|---|---|
| | | YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGGSGGGSGGGSGLNDFFEAQKIEWHE |
| EFM161 | 160 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWKHEST<br>FQRAKFIRQKTYVEEIKGKLNVKCAGMPDRIKKLVTFDNFEVGFSSYGKLLPKRTQGGVVLVD<br>TMFTIKGHHHHHHHHGGGSGGGSGGGSGLNDFFEAQKIEWHE |
| EFM162 | 161 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGGSGGGSGGGSGLNDFFEAQKIEWHE |
| EFM163 | 162 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPIKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGGSGGGSGGGSGLNDFFEAQKIEWHE |
| EFM164 | 163 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTEVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGGSGGGSGGGSGLNDFFEAQKIEWHE |
| EFM165 | 164 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGGSGGGSGGGSGLNDFFEAQKIEWHE |
| EFM166 | 165 | MIKKYTGDFETTTDLNDCRVWSWGVCDIDNVDNITFGLEIDSFFEWCEMQGSTDIYFHNEKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIDGKLNVKCAGMPDRIKKLVTFDNFEVGFSSYGKLLPKRTQGGVVLVD<br>TMFTIKGHHHHHHHHGGGSGGGSGGGSGLNDFFEAQKIEWHE |
| EFM168 | 166 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE |

TABLE 2-continued

E. faecium polymerase variants

| Name | SEQ ID NO: | Sequence |
|---|---|---|

<br>IGEGIVFDVNSHYPSQMYVRPLPYGTPLFYEGEYKENIDYPLYIQNIKVRFRLKEGHIPTIQV
<br>KQSSLFIQNEYLESSVNKLGVDELIDLTLTNVDLDLFFEHYDILEIHYTYGYMFKASCDMPKG
<br>WIDKWIEVKNTTYGARKANAKGMLNSLYGKFGTNPDITGKVPYMGEDGIVRLTLGEEELRDPV
<br>YVPLASFVTAWGRYTTITTAQRCFDNIIYCDTDSIHLTGTKVPEAIEHLVHSKKLGYWEHEST
<br>FQRAKFIRQKTYVEEIKGKLNVKCAGMPDRIKKLVTFDNFEVGFSSYGKLLPKRTQGGVVLVD
<br>TMFTIKGHHHHHHHHGGGSGGGSGGGSGLNDFFEAQKIEWHEGGGSGGGSGGGSGLNDFFE
<br>AQKIEWHE

EFM169  167  MIKKYTGDFETTTDLNDCRVWSWGVCDIDNVDNITFGLEIDSFFEWCEMQGSTDIYFHNLKFD
<br>GEFMLSWLFKNGFKWCKEAKEERTFSTLISNMGQWYALEICWNVKCTTTKTGKTKKEKQRTII
<br>YDSLKKYPFPVKEIAKAFNFPKKKGEIDYTKERPIGYNPTDDEWDYLKNDIQIMAMALKIQFK
<br>QGLTRMTRGSDALGDYQDWVKTTYGKSRFKQWFPVLSLGFDKDLRKAYKGGFTWVNKVFQGKE
<br>IGEGIVFDINSHYPSQMYVRPLPYGTPLFYEGEYKENIDYPLYIQNIKVRFRLKEGHIPTIQV
<br>KQSSLFIQNEYLESSVNKLGVDELIDLTLTNVDLDLFFEHYDILEIHYTYGYMFKASCDMFKG
<br>WIDKWIEVKNTTYGARKANAKGMLNSLYGKFGTNPDITGKVPYMGEDGIVRLTLGEEELRDPV
<br>YVPLASFVTAWGRYTTITTAQRCFDNIIYCDTDSIHLTGTKVPEAIEHLVHSKKLGYWEHEST
<br>FQRAKFIRQKTYVEEIKGKLNVKCAGMPDRIKKLVTFDNFEVGFSSYGKLLPKRTQGGVVLVD
<br>TMFTIKGHHHHHHHHGGGSGGGSGGGSGLNDFFEAQKIEWHEGGGSGGGSGGGSGLNDFFE
<br>AQKIEWHE

EFM170  168  MIKKYTGDFETTTDLNDCRVWSWGVCDIDNVDNITFGLEIDSFFEWCEMQGSTDIYFHNLKFD
<br>GEFMLSWLFKNGFKWCKEAKEERTFSTLISNMGQWYALEICWNVKCTTTKTGKTKKEKQRTII
<br>YDSLKKYPFPVKEIAKAFNFPKKKGEIDYTKERPIGYNPTDDEWDYLKNDIQIMAMALKIQFK
<br>QGLTRMTRGSDALGDYQDWVKTTYGKSRFKQWFPVLSLGFDKDLRKAYKGGFTWVNKVFQGKE
<br>IGEGIVFDANSAYPSQMYVRPLPYGTPLFYEGEYKENIDYPLYIQNIKVRFRLKEGHIPTIQV
<br>KQSSLFIQNEYLESSVNKLGVDELIDLTLTNVDLDLFFEHYDILEIHYTYGYMFKASCDMFKG
<br>WIDKWIEVKNTTYGARKANAKGMLNSLYGKFGTNPDITGKVPYMGEDGIVRLTLGEEELRDPV
<br>YVPLASFVTAWGRYTTITTAQRCFDNIIYCDTDSIHLTGTKVPEAIEHLVHSKKLGYWEHEST
<br>FQRAKFIRQKTYVEEIKGKLNVKCAGMPDRIKKLVTFDNFEVGFSSYGKLLPKRTQGGVVLVD
<br>TMFTIKGHHHHHHHHGGGSGGGSGGGSGLNDFFEAQKIEWHEGGGSGGGSGGGSGLNDFFE
<br>AQKIEWHE

EFM171  169  MIKKYTGDFETTTDLNDCRVWSWGVCDIDNVDNITFGLEIDSFFEWCEMQGSTDIYFHNLKFD
<br>GEFMLSWLFKNGFKWCKEAKEERTFSTLISNMGQWYALEICWNVKCTTTKTGKTKKEKQRTII
<br>YDSLKKYPFPVKEIAKAFNFPKKKGEIDYTKERPIGYNPTDDEWDYLKNDIQIMAMALKIQFK
<br>QGLTRMTRGSDALGDYQDWVKTTYGKSRFKQWFPVLSLGFDKDLRKAYKGGFTWVNKVFQGKE
<br>IGEGIVFDVNSAYPSQMYVRPLPYGTPLFYEGEYKENIDYPLYIQNIKVRFRLKEGHIPTIQV
<br>KQSSLFIQNEYLESSVNKLGVDELIDLTLTNVDLDLFFEHYDILEIHYTYGYMFKASCDMFKG
<br>WIDKWIEVKNTTYGARKANAKGMLNSLYGKFGTNPDITGKVPYMGEDGIVRLTLGEEELRDPV
<br>YVPLASFVTAWGRYTTITTAQRCFDNIIYCDTDSIHLTGTKVPEAIEHLVHSKKLGYWEHEST
<br>FQRAKFIRQKTYVEEIKGKLNVKCAGMPDRIKKLVTFDNFEVGFSSYGKLLPKRTQGGVVLVD
<br>TMFTIKGHHHHHHHHGGGSGGGSGGGSGLNDFFEAQKIEWHEGGGSGGGSGGGSGLNDFFE
<br>AQKIEWHE

EFM172  170  MIKKYTGDFETTTDLNDCRVWSWGVCDIDNVDNITFGLEIDSFFEWCEMQGSTDIYFHNLKFD
<br>GEFMLSWLFKNGFKWCKEAKEERTFSTLISNMGQWYALEICWNVKCTTTKTGKTKKEKQRTII
<br>YDSLKKYPFPVKEIAKAFNFPKKKGEIDYTKERPIGYNPTDDEWDYLKNDIQIMAMALKIQFK
<br>QGLTRMTRGSDALGDYQDWVKTTYGKSRFKQWFPVLSLGFDKDLRKAYKGGFTWVNKVFQGKE
<br>IGEGIVFDINSAYPSQMYVRPLPYGTPLFYEGEYKENIDYPLYIQNIKVRFRLKEGHIPTIQV
<br>KQSSLFIQNEYLESSVNKLGVDELIDLTLTNVDLDLFFEHYDILEIHYTYGYMFKASCDMFKG
<br>WIDKWIEVKNTTYGARKANAKGMLNSLYGKFGTNPDITGKVPYMGEDGIVRLTLGEEELRDPV
<br>YVPLASFVTAWGRYTTITTAQRCFDNIIYCDTDSIHLTGTKVPEAIEHLVHSKKLGYWEHEST
<br>FQRAKFIRQKTYVEEIKGKLNVKCAGMPDRIKKLVTFDNFEVGFSSYGKLLPKRTQGGVVLVD
<br>TMFTIKGHHHHHHHHGGGSGGGSGGGSGLNDFFEAQKIEWHEGGGSGGGSGGGSGLNDFFE
<br>AQKIEWHE

EFM173  171  MIKKYTGDFETTTDLNDCRVWSWGVCDIDNVDNITFGLEIDSFFEWCEMQGSTDIYFHNLKFD
<br>GEFMLSWLFKNGFKWCKEAKEERTFSTLISNMGQWYALEICWNVKCTTTKTGKTKKEKQRTII
<br>YDSLKKYPFPVKEIAKAFNFPKKKGEIDYTKERPIGYNPTDDEWDYLKNDIQIMAMALKIQFK
<br>QGLTRMTRGSDALGDYQDWVKTTYGKSRFKQWFPVLSLGFDKDLRKAYKGGFTWVNKVFQGKE
<br>IGEGIVFDANSMYPSQMYVRPLPYGTPLFYEGEYKENIDYPLYIQNIKVRFRLKEGHIPTIQV
<br>KQSSLFIQNEYLESSVNKLGVDELIDLTLTNVDLDLFFEHYDILEIHYTYGYMFKASCDMFKG
<br>WIDKWIEVKNTTYGARKANAKGMLNSLYGKFGTNPDITGKVPYMGEDGIVRLTLGEEELRDPV
<br>YVPLASFVTAWGRYTTITTAQRCFDNIIYCDTDSIHLTGTKVPEAIEHLVHSKKLGYWEHEST
<br>FQRAKFIRQKTYVEEIKGKLNVKCAGMPDRIKKLVTFDNFEVGFSSYGKLLPKRTQGGVVLVD
<br>TMFTIKGHHHHHHHHGGGSGGGSGGGSGLNDFFEAQKIEWHEGGGSGGGSGGGSGLNDFFE
<br>AQKIEWHE

EFM174  172  MIKKYTGDFETTTDLNDCRVWSWGVCDIDNVDNITFGLEIDSFFEWCEMQGSTDIYFHNLKFD
<br>GEFMLSWLFKNGFKWCKEAKEERTFSTLISNMGQWYALEICWNVKCTTTKTGKTKKEKQRTII
<br>YDSLKKYPFPVKEIAKAFNFPKKKGEIDYTKERPIGYNPTDDEWDYLKNDIQIMAMALKIQFK
<br>QGLTRMTRGSDALGDYQDWVKTTYGKSRFKQWFPVLSLGFDKDLRKAYKGGFTWVNKVFQGKE
<br>IGEGIVFDVNSMYPSQMYVRPLPYGTPLFYEGEYKENIDYPLYIQNIKVRFRLKEGHIPTIQV
<br>KQSSLFIQNEYLESSVNKLGVDELIDLTLTNVDLDLFFEHYDILEIHYTYGYMFKASCDMFKG

TABLE 2-continued

*E. faecium* polymerase variants

| Name | SEQ ID NO: | Sequence |
|---|---|---|
| | | WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM175 | 173 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQPFK<br>QGLTRMTRGSDALGDYQDWVKTTYGKSRFKQWFPVLSLGFDKDLRKAYKGGFTWVNKVFQGKE<br>IGEGIVFDINSMYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM176 | 174 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQPFK<br>QGLTRMTRGSDALGDYQDWVKTTYGKSRFKQWFPVLSLGFDKDLRKAYKGGFTWVNKVFQGKE<br>IGEGIVFDANSLYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM177 | 175 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQPFK<br>QGLTRMTRGSDALGDYQDWVKTTYGKSRFKQWFPVLSLGFDKDLRKAYKGGFTWVNKVFQGKE<br>IGEGIVFDVNSLYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM178 | 176 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQPFK<br>QGLTRMTRGSDALGDYQDWVKTTYGKSRFKQWFPVLSLGFDKDLRKAYKGGFTWVNKVFQGKE<br>IGEGIVFDINSLYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM179 | 177 | MIKKYTGDFETTTDLNDCRVWAWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQPFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM180 | 178 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQPFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELITLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST |

TABLE 2-continued

_E. faecium polymerase variants_

| Name | SEQ ID NO: | Sequence |
|---|---|---|

FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM181 179 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM182 180 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM183 181 MIKKYTGDFETTTDLNDCRVWSWGVCDIDNVDNITFGLEIDSFFEWCEMQGSTDIYFHNLKFD
GEFMLSWLFKNGFKWCKEAKEPRTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM184 182 MIKRYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM185 183 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRDKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM186 184 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKKLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV

TABLE 2-continued

E. faecium polymerase variants

| Name | SEQ ID NO: | Sequence |
|---|---|---|
| | | YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE |
| EFM187 | 185 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE |
| EFM188 | 186 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKERHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE |
| EFM189 | 187 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPIKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE |
| EFM190 | 188 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTEVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE |
| EFM191 | 189 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVDSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE |
| EFM192 | 190 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIDGKLNVKCAGMPDRIKKLVTFDNFEVGFSSYGKLLPKRTQGGVVLVD |

TABLE 2-continued

_E. faecium polymerase variants_

| Name | SEQ ID NO: | Sequence |
|---|---|---|
| | | TMFTIKGHHHHHHHHHHGGGSGGGSGGGSGLNDFFEAQKIEWHEGGGSGGGSGGGSGLNDFFE<br>AQKIEWHE |
| EFM193 | 191 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM194 | 192 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM195 | 193 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM196 | 194 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWFEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM197 | 195 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWSEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM198 | 196 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>DTFTIKGHHHHHHHHHHGGGSGGGSGGGSGLNDFFEAQKIEWHEGGGSGGGSGGGSGLNDFFE<br>AQKIEWHE |

TABLE 2-continued

E. faecium polymerase variants

| Name | SEQ ID NO: | Sequence |
|---|---|---|
| EFM199 | 197 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDVVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>SVFTIKGHHHHHHHHHHGGSGGGSGGGSGLNDFFEAQKIEWHEGGGSGGGSGGGSGLNDFFE<br>AQKIEWHE |
| EFM200 | 198 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDVVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLAKRTQGGVVLVD<br>TMFTIKGHHHHHHHHHHGGSGGGSGGGSGLNDFFEAQKIEWHEGGGSGGGSGGGSGLNDFFE<br>AQKIEWHE |
| EFM201 | 199 | MIKKYTGDFETTTDLNDCRVWSWGVCDIDNVDNITFGLEIDSFFEWCEMQGSTDIYFHNLKFD<br>GSFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDVVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHHGGSGGGSGGGSGLNDFFEAQKIEWHEGGGSGGGSGGGSGLNDFFE<br>AQKIEWHE |
| EFM202 | 200 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDVVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEERLRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHHGGSGGGSGGGSGLNDFFEAQKIEWHEGGGSGGGSGGGSGLNDFFE<br>AQKIEWHE |
| EFM203 | 201 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDVVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAYGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHHGGSGGGSGGGSGLNDFFEAQKIEWHEGGGSGGGSGGGSGLNDFFE<br>AQKIEWHE |
| EFM204 | 202 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDVVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAWGRWTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHHGGSGGGSGGGSGLNDFFEAQKIEWHEGGGSGGGSGGGSGLNDFFE<br>AQKIEWHE |

TABLE 2-continued

E. faecium polymerase variants

| Name | SEQ ID NO: | Sequence |
|---|---|---|
| EFM205 | 203 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM206 | 204 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEYRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM207 | 205 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEERDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM208 | 206 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAWGRYTTITTAQRCFDNIIYCDTDSIHLTGTKVPEAIEHLVHSKKLGYWEHEAT<br>FQRAKFIRQKTYVEEIKGKLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM209 | 207 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAWARYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM210 | 208 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTYGARKANAKGMLNSLYGKFGTNPDITGKVPYMGEDGIVRLTLGEEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGKLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |

TABLE 2-continued

*E. faecium* polymerase variants

| Name | SEQ ID NO: | Sequence |
|---|---|---|
| EFM211 | 209 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPAQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE |
| EFM212 | 210 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTYGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGKLNVKCAGMPDRIKKLVTFDNFEVGFSSYGKLKPKRTQGGVVLVD
TMFTIKGHHHHHHHHHGGSGGGSGGGSGLNDFFEAQKIEWHEGGGSGGGSGGGSGLNDFFE
AQKIEWHE |
| EFM213 | 211 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE |
| EFM232 | 212 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKLPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE |
| EFM233 | 213 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPAQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE |
| EFM234 | 214 | MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVDSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE |

TABLE 2-continued

E. faecium polymerase variants

| Name | SEQ ID NO: | Sequence |
|---|---|---|
| EFM235 | 215 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM236 | 216 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM237 | 217 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM238 | 218 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM239 | 219 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM240 | 220 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |

TABLE 2-continued

_E. faecium polymerase variants_

| Name | SEQ ID NO: | Sequence |
|---|---|---|
| EFM241 | 221 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM242 | 222 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM243 | 223 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM244 | 224 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM245 | 225 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |
| EFM246 | 226 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGSGGGSGGGSGLNDFFEAQKIEWHEGGGSGGGSGGGSGLNDFFE<br>AQKIEWHE |

TABLE 2-continued

_E. faecium polymerase variants_

| Name | SEQ ID NO: | Sequence |
|---|---|---|
| EFM247 | 227 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM248 | 228 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM249 | 229 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM250 | 230 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM251 | 231 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM252 | 232 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV |

TABLE 2-continued

*E. faecium* polymerase variants

| Name | SEQ ID NO: | Sequence |
|---|---|---|
| | | YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM253 | 233 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM254 | 234 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM255 | 235 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM256 | 236 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM257 | 237 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM258 | 238 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD |

TABLE 2-continued

E. faecium polymerase variants

| Name | SEQ ID NO: | Sequence |
|---|---|---|
| | | TMFTIKGHHHHHHHHHHGGGSGGGSGGGSGLNDFFEAQKIEWHEGGGSGGGSGGGSGLNDFFE<br>AQKIEWHE |
| EFM259 | 239 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM260 | 240 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM261 | 241 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM262 | 242 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSHYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM263 | 243 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDLNSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |
| EFM264 | 244 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVKSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHHGGGSGGGSGGGSGLNDFFEAQKIEWHEGGGSGGGSGGGSGLNDFFE<br>AQKIEWHE |

TABLE 2-continued

*E. faecium* polymerase variants

| Name | SEQ ID NO: | Sequence |
|---|---|---|

EFM265 245 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVASKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE

EFM266 246 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVSSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE

EFM267 247 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKERHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE

EFM268 248 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWFEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE

EFM269 249 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWSEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE

EFM270 250 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDLNSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV

TABLE 2-continued

E. faecium polymerase variants

| Name | SEQ ID NO: | Sequence |
|---|---|---|
| | | YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGGSGGGSGGGSGLNDFFEAQKIEWHEGGGSGGGSGGGSGLNDFFE<br>AQKIEWHE |
| EFM271 | 251 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDVNSAYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGGSGGGSGGGSGLNDFFEAQKIEWHEGGGSGGGSGGGSGLNDFFE<br>AQKIEWHE |
| EFM272 | 252 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDINSAYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGGSGGGSGGGSGLNDFFEAQKIEWHEGGGSGGGSGGGSGLNDFFE<br>AQKIEWHE |
| EFM273 | 253 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDINSAYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGGSGGGSGGGSGLNDFFEAQKIEWHEGGGSGGGSGGGSGLNDFFE<br>AQKIEWHE |
| EFM274 | 254 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDINSAYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVDSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGGSGGGSGGGSGLNDFFEAQKIEWHEGGGSGGGSGGGSGLNDFFE<br>AQKIEWHE |
| EFM275 | 255 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDINSAYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAYGRWTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGGSGGGSGGGSGLNDFFEAQKIEWHEGGGSGGGSGGGSGLNDFFE<br>AQKIEWHE |
| EFM276 | 256 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKLPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDINSAYPAQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD |

TABLE 2-continued

*E. faecium* polymerase variants

| Name | SEQ ID NO: | Sequence |
|---|---|---|

TMFTIKGHHHHHHHHHGGGSGGGSGGGSGLNDFFEAQKIEWHEGGGSGGGSGGGSGLNDFFE
AQKIEWHE

EFM277 257 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKLPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVDSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGGSGGGSGGGSGLNDFFEAQKIEWHEGGGSGGGSGGGSGLNDFFE
AQKIEWHE

EFM278 258 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKLPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAYGRWTTITTAQRCFDNIIYCDTDSIHLTGTKVPEAIEHLVSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGGSGGGSGGGSGLNDFFEAQKIEWHEGGGSGGGSGGGSGLNDFFE
AQKIEWHE

EFM279 259 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPAQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVDSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGGSGGGSGGGSGLNDFFEAQKIEWHEGGGSGGGSGGGSGLNDFFE
AQKIEWHE

EFM280 260 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPAQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAYGRWTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGGSGGGSGGGSGLNDFFEAQKIEWHEGGGSGGGSGGGSGLNDFFE
AQKIEWHE

EFM281 261 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAYGRWTTITTAQRCFDNIIYCDTDSIHLTGTKVPEAIEHLVDSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGGSGGGSGGGSGLNDFFEAQKIEWHEGGGSGGGSGGGSGLNDFFE
AQKIEWHE

EFM282 262 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKLPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPAQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVDSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGGSGGGSGGGSGLNDFFEAQKIEWHEGGGSGGGSGGGSGLNDFFE
AQKIEWHE

TABLE 2-continued

*E. faecium* polymerase variants

| Name | SEQ ID NO: | Sequence |
|---|---|---|

EFM283 263 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKLPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPAQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAYGRWTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM284 264 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKLPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAYGRWTTITTAQRCFDNIIYCDTDSIHLTGTKVPEAIEHLVDSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM286 265 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPAQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAYGRWTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM287 266 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKLPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPAQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAYGRWTTITTAQRCFDNIIYCDTDSIHLTGTKVPEAIEHLVDSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM288 267 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDLNSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM289 268 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE

TABLE 2-continued

E. faecium polymerase variants

| Name | SEQ ID NO: | Sequence |
|---|---|---|

IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVKSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM290 269 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVASKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM291 270 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVSSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM292 271 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKERHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM293 272 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWFEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM294 273 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDINSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWSEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM295 274 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDVNSAYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG

TABLE 2-continued

E. faecium polymerase variants

| Name | SEQ ID NO: | Sequence |
|---|---|---|
| | | WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM296 | 275 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGENGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM297 | 276 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM298 | 277 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGENGIVLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM299 | 278 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNTGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM300 | 279 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHGGSGGGSGGGSGLNDFFEAQKIEWHEGGGSGGGSGGGSGLNDFFE<br>AQKIEWHE |
| EFM301 | 280 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAQAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST |

TABLE 2-continued

E. faecium polymerase variants

| Name | SEQ ID NO: | Sequence |
|---|---|---|
| | | FQRAKFIRQKTYVEEIKGYLNVKCAGMPDRIKKLVTFDNFEVGFSSYGKLLPKRTQGGVVLVD<br>TMFTIKGHHHHHHHHHGGGSGGGSGGGSGLNDFFEAQKIEWHEGGGSGGGSGGGSGLNDFFE<br>AQKIEWHE |
| EFM302 | 281 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFKFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGGSGGGSGGGSGLNDFFEAQKIEWHEGGGSGGGSGGGSGLNDFFE<br>AQKIEWHE |
| EFM303 | 282 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKKIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGGSGGGSGGGSGLNDFFEAQKIEWHEGGGSGGGSGGGSGLNDFFE<br>AQKIEWHE |
| EFM304 | 283 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKQIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGGSGGGSGGGSGLNDFFEAQKIEWHEGGGSGGGSGGGSGLNDFFE<br>AQKIEWHE |
| EFM305 | 284 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYRDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGGSGGGSGGGSGLNDFFEAQKIEWHEGGGSGGGSGGGSGLNDFFE<br>AQKIEWHE |
| EFM306 | 285 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYKDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPDRIKKLVTFDNFEVGFSSYGKLLPKRTQGGVVLVD<br>TMFTIKGHHHHHHHHHGGGSGGGSGGGSGLNDFFEAQKIEWHEGGGSGGGSGGGSGLNDFFE<br>AQKIEWHE |
| EFM307 | 286 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE |

TABLE 2-continued

E. faecium polymerase variants

| Name | SEQ ID NO: | Sequence |
|---|---|---|

IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDRIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM308 287 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIGNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM309 288 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPVITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM310 289 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KRSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM311 290 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSRLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM312 291 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFKQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGGSGGGSGGGSGLNDFFEAQKIEWHEGGGSGGGSGGGSGLNDFFE
AQKIEWHE

EFM313 292 MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIGNEYLESSVNKLGVDELIDLTLTNVDLDLFFEHYDILEIHYTYGYMFKASCDMFKG

TABLE 2-continued

E. faecium polymerase variants

| Name | SEQ ID NO: | Sequence |
|---|---|---|

EFM314 293
```
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE
```

EFM314 293
```
MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQPFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KRSRLFKGNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE
```

EFM315 294
```
MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQPFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YTPLASFVAAYGRWTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE
```

EFM316 295
```
MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQPFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YTPMGVFITAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE
```

EFM317 296
```
MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQPFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFKVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE
```

EFM318 297
```
MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQPFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCYDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHGGSGGGSGGGSGLNDFFEAQKIEWHEGGGSGGGSGGGSGLNDFFE
AQKIEWHE
```

EFM319 298
```
MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQPFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
```

TABLE 2-continued

*E. faecium* polymerase variants

| Name | SEQ ID NO: | Sequence |
|---|---|---|

FQRAKFIRQKTYVEEIKGWLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM320  299  MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFR
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM321  300  MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIARAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM322  301  MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKRLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM323  302  MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCDMFKG
WIDKWIYVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM324  303  MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV
KQSSLFIQNEYLESSVNKLGVDELIDLTLTNVDLDLFFEHYDILEIHYTYGYMFKASCGMFKG
WIDKWIEVKNTTWGARKANAKGMLNSLYGKFGTNPDITGKVPYMGEDGIVRLTLGEEELRDPV
YVPLASFVTAWGRYTTITTAQRCFDNIIYCDTDSIHLTGTKVPEAIEHLVHSKKLGYWEHEST
FQRAKFIRQKTYVEEIKGYLNVKCAGMPDRIKKLVTFDNFEVGFSSYGKLLPKRTQGGVVLVD
TMFTIKGHHHHHHHHHGGSGGGSGGGSGLNDFFEAQKIEWHEGGGSGGGSGGGSGLNDFFE
AQKIEWHE

EFM325  304  MIKKYTGDFETTTDLNDCRVWSWGVCDIDNVDNITFGLEIDSFFEWCEMQGSTDIYFHNLKFD
GEFMLSWLFKNGFKWCKEAKEERTFSTLISNMGQWYALEICWNVKCTTTKTGKTKKEKQRTII
YDSLKKYPFPVKEIAKAFNFPKKKGEIDYTKERPIGYNPTDDEWDYLKNDIQIMAMALKIQFK
QGLTRMTRGSDALGDYQDWVKTTYGKSRFKQWFPVLSLGFDKDLRKAYKGGFTWVNKVFQGKE
IGEGIVFDANSHYPSQMYVRPLPYGTPLFYEGEYKENIDYPLYIQNIKVRFRLKEGHIPTIQV

TABLE 2-continued

E. faecium polymerase variants

| Name | SEQ ID NO: | Sequence |
|---|---|---|
| | | KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIKGYLNVKCAGMPARIKKLVTFDNFEVGFSSYGKLLPKRTQGGVVLVD<br>TMFTIKGHHHHHHHHGGGSGGGSGGGSGLNDFFEAQKIEWHEGGGSGGGSGGGSGLNDFFE<br>AQKIEWHE |
| EFM326 | 305 | MIKKYTGDFETTTDLNDCRVWSWGVCDIDNVDNITFGLEIDSFFEWCEMQGSTDIYFHNLKFD<br>GEFMLSWLFKNGFKWCKEAKEERTFSTLISNMGQWYALEICWNVKCTTTKTGKTKKEKQRTII<br>YDSLKKYPFPVKEIAKAFNFPKKKGEIDYTKERPIGYNPTDDEWDYLKNDIQIMAMALKIQFK<br>QGLTRMTRGSDALGDYQDWVKTTYGKSRFKQWFPVLSLGFDKDLRKAYKGGFTWVNKVFQGKE<br>IGEGIVFDANSHYPSQMYVRPLPYGTPLFYEGEYKENIDYPLYIQNIKVRFRLKEGHIPTIQV<br>KQSSLFIQNEYLESSVNKLGVDELIDLTLTNVDLDLFFEHYDILEIHYTYGYMFKASCDMFKG<br>WIDKWIEVKNTTWGARKANAKGMLNSLYGKFGTNPDITGKVPYMGEDGIVRLTLGEEELRDPV<br>YVPLASFVTAWGRYTTITTAQRCFDNIIYCDTDSIHLTGTKVPEAIEHLVHSKKLGYWEHEST<br>FQRAKFIRQKTYVEEIRGYLNVKCAGMPDRIKKLVTFDNFEVGFSSYGKLLPKRTQGGVVLVD<br>TMFTIKGHHHHHHHHGGGSGGGSGGGSGLNDFFEAQKIEWHEGGGSGGGSGGGSGLNDFFE<br>AQKIEWHE |

TABLE 3

Homologous Polymerase Variants

| Name | SEQ ID NO | Sequence |
|---|---|---|
| H008 | 306 | MSRKMFSCDFETTTKLDDCRVWAYGYMEIGNLDNYKIGNSLDEFMQWVMEIQADLYFHNLKF<br>DGAFIVNWLEQHGFKWSNEGLPNTYNTIISKMGQWYMIDICFGYKGKRKLHTVIYDSLKKLP<br>FPVKKIAKDFQLPLLKGDIDIHTERPVGHEITPEEYEYIKNDIEIIARALDIQFKQGLDRMT<br>AGSDSLKGFKDILSTKKFNKVFPKLSLPMDKEIRKAYRGGFTWLNDKYKEKEIGEGMVFDVN<br>SLYPSQMYSRPLPYGAPIVFQGKYEKDEQYPLYIQRIRFEFELKEGYIPTIQIKKNPFFKGN<br>EYLKNSGVEPVELYLTNVDLELIQEHYELYNVEYIDGFKFREKTGLFKDFIDKWTYVKTHEE<br>GAKKQLAKLMLNSLYGKFASNPDVTGKVPYLKDDGSLGFRVGDEEYKDPVYTPMGVFITAWA<br>RFTTITAAQACYDRIIYCDTDSIHLTGTEVPEIIKDIVDPKKLGYWEHESTFKRAKYLRQKT<br>YIQDIYVKEVDGKLKECSPDEATTTKFSVKCAGMTDTIKKKVTFDNFAVGFSSMGKPKPVQV<br>NGGVVLVDSVFTIK |
| H009 | 307 | MSRKMFSCDFETTTKLDDCRVWAYGYMEIGNLDNYKIGNSLDEFMQWVMEIQADLYFHNLKF<br>DGAFIVNWLEQHGFKWSNEGLPNTYNTIISKMGQWYMIDICFGYKGKRKLHTVIYDSLKKLP<br>FPVKKIAKDFQLPLLKGDIDIHTERPVGHEITPEEYEYIKNDIEIIARALDIQFKQGLDRMT<br>AGSDSLKGFKDILSTKKFNKVFPKLSLPMDKEIRKAYRGGFTWLNDKYKEKEIGEGMVFDAN<br>SAYPSQMYSRPLPYGAPIVFQGKYEKDEQYPLYIQRIRFEFELKEGYIPTIQIKKNPFFKGN<br>EYLKNSGVEPVELYLTNVDLELIQEHYELYNVEYIDGFKFREKTGLFKDFIDKWTYVKTHEE<br>GAKKQLAKLMLNSLYGKFASNPDVTGKVPYLKDDGSLGFRVGDEEYKDPVYTPMGVFITAWA<br>RFTTITAAQACYDRIIYCDTDSIHLTGTEVPEIIKDIVDPKKLGYWEHESTFKRAKYLRQKT<br>YIQDIYVKEVDGKLKECSPDEATTTKFSVKCAGMTDTIKKKVTFDNFAVGFSSMGKPKPVQV<br>NGGVVLVDSVFTIK |
| H010 | 308 | MSRKMFSCDFETTTKLDDCRVWAYGYMEIGNLDNYKIGNSLDEFMQWVMEIQADLYFHNLKF<br>DGAFIVNWLEQHGFKWSNEGLPNTYNTIISKMGQWYMIDICFGYKGKRKLHTVIYDSLKKLP<br>FPVKKIAKDFQLPLLKGDIDIHTERPVGHEITPEEYEYIKNDIEIIARALDIQFKQGLDRMT<br>AGSDSLKGFKDILSTKKFNKVFPKLSLPMDKEIRKAYRGGFTWLNDKYKEKEIGEGMVFDAN<br>SAYPSQMYSRPLPYGAPIVFQGKYEKDEQYPLYIQRIRFEFELKEGYIPTIQIKKNPFFKGN<br>EYLKNSGVEPVELYLTNVDLELIQEHYELYNVEYIDGFKFREKTGLFKDFIDKWTYVKTHEY<br>GAKKQLAKLMLNSLYGKFASNPDVTGKVPYLKDDGSLGFRVGDEEYKDPVYTPMGVFITAWA<br>RFTTITAAQACYDRIIYCDTDSIHLTGTEVPEIIKDIVDPKKLGYWEHESTFKRAKYLRQKT<br>YIQDIYVKEVDGYLKECSPDEATTTKFSVKCAGMTDTIKKKVTFDNFAVGFSSMGKPKPVQV<br>NGGVVLVDSVFTIK |
| H011 | 309 | MSRKMFSCDFETTTKLDDCRVWAYGYMEIGNLDNYKIGNSLDEFMQWVMEIQADLYFHDLKF<br>DGAFIVNWLEQHGFKWSNEGLPNTYNTIISKMGQWYMIDICFGYKGKRKLHTVIYDSLKKLP<br>FPVKKIAKDFQLPLLKGDIDYHTERPVGHEITPEEYEYIKNDIEIIARALDIQFKQGLDRMT<br>AGSDSLKGFKDILSTKKFNKVFPKLSLPMDKEIRKAYRGGFTWLNDKYKEKEIGEGMVFDAN<br>SAYPSQMYSRPLPYGAPIVFQGKYEKDEQYPLYIQRIRFEFELKEGYIPTIQIKKNPFFKGN<br>EYLKNSGVEPVELYLTNVDLELIQEHYELYNVEYIDGFKFREKTGLFKDFIDKWTYVKTHEY<br>GAKKQLAKLMLNSLYGKFASNPDVTGKVPYLKDDGSLGFRVGDEEYKDPVYTPMGVFITAWA<br>RFTTITAAQACYDRIIYCDTDSIHLTGTEVPEIIKDIVDPKKLGYWEHESTFKRAKYLRQKT<br>YIQDIYVKEVDGYLKECSPDEATTTKFSVKCAGMTDTIKKKVTFDNFAVGFSSMGKPKPVQV<br>NGGVVLVDSVFTIK |

TABLE 3-continued

Homologous Polymerase Variants

| Name | SEQ ID NO | Sequence |
|---|---|---|
| H012 | 310 | MIKKYTGDFETTTDLNDCRVWSWGVCDIDNVDNITFGLEIDSFFEWCEMQGSTDIYFHNEKF
DGEFMLSWLFKNGFKWCKEAKEERTFSTLISNMGQWYALEICWNVKCTTTKTGKTKKEKQRT
IIYDSLKKYPFPVKEIAEAFNFPIKKGEIDITKERPIGYNPTDDEWDYLKNDIQIMAMALKI
QFDQGLTRMTRGSDALGDYQDWVKTTYGKSRFKQWFPVLSLGFDKDLRKAYKGGFTWVNKVF
QGKEIGEGIVFDVNSLYPSQMYVRPLPYGTPLFYEGEYKENIDYPLYIQNIKVRFRLKERHI
PTIQVKQSSLFIQNEYLESSVNKLGVDELIDLTLTNVDLDLFFEHYDILEIHYTYGYMFKAS
CDMFKGWIDKWIEVKNTTEGARKANAKGMLNSLYGKFGTNPDITGKVPYMGEDGIVRLTLGE
EELRDPVYVPLASFVTAWGRYTTITTAQRCFDNIIYCDTDSIHLTGTEVPEAIEHLVDSKKL
GYWEHESTFQRAKFIRQKTYVEEIDGELNVKCAGMPDRIKELVTFDNFEVGFSSYGKLLPKR
TQGGVVLVDTMFTIK |
| H013 | 311 | MIKKYTGDFETTTDLNDCRVWSWGVCDIDNVDNITFGLEIDSFFEWCEMQGSTDIYFHNEKF
DGEFMLSWLFKNGFKWCKEAKEERTFSTLISNMGQWYALEICWNVKCTTTKTGKTKKEKQRT
IIYDSLKKYPFPVKEIAEAFNFPIKKGEIDITKERPIGYNPTDDEWDYLKNDIQIMAMALKI
QFDQGLTRMTRGSDALGDYQDWVKTTYGKSRFKQWFPVLSLGFDKDLRKAYKGGFTWVNKVF
QGKEIGEGIVFDANSAYPSQMYVRPLPYGTPLFYEGEYKENIDYPLYIQNIKVRFRLKERHI
PTIQVKQSSLFIQNEYLESSVNKLGVDELIDLTLTNVDLDLFFEHYDILEIHYTYGYMFKAS
CDMFKGWIDKWIEVKNTTEGARKANAKGMLNSLYGKFGTNPDITGKVPYMGEDGIVRLTLGE
EELRDPVYVPLASFVTAWGRYTTITTAQRCFDNIIYCDTDSIHLTGTEVPEAIEHLVDSKKL
GYWEHESTFQRAKFIRQKTYVEEIDGELNVKCAGMPDRIKELVTFDNFEVGFSSYGKLLPKR
TQGGVVLVDTMFTIK |
| H014 | 312 | MIKKYTGDFETTTDLNDCRVWSWGVCDIDNVDNITFGLEIDSFFEWCEMQGSTDIYFHNEKF
DGEFMLSWLFKNGFKWCKEAKEERTFSTLISNMGQWYALEICWNVKCTTTKTGKTKKEKQRT
IIYDSLKKYPFPVKEIAEAFNFPIKKGEIDITKERPIGYNPTDDEWDYLKNDIQIMAMALKI
QFDQGLTRMTRGSDALGDYQDWVKTTYGKSRFKQWFPVLSLGFDKDLRKAYKGGFTWVNKVF
QGKEIGEGIVFDANSAYPSQMYVRPLPYGTPLFYEGEYKENIDYPLYIQNIKVRFRLKERHI
PTIQVKQSSLFIQNEYLESSVNKLGVDELIDLTLTNVDLDLFFEHYDILEIHYTYGYMFKAS
CDMFKGWIDKWIEVKNTTYGARKANAKGMLNSLYGKFGTNPDITGKVPYMGEDGIVRLTLGE
EELRDPVYVPLASFVTAWGRYTTITTAQRCFDNIIYCDTDSIHLTGTEVPEAIEHLVDSKKL
GYWEHESTFQRAKFIRQKTYVEEIDGELNVKCAGMPDRIKELVTFDNFEVGFSSYGKLLPKR
TQGGVVLVDTMFTIK |
| H016 | 313 | MSRKMFSCDFETTTKLDDCRVWAYGYMEIGNLDNYKIGNSLDEFMQWVMEIQADLYFHDLKF
DGAFIVNWLEQHGFKWSNEGLPNTYNTIISKMGQWYMIDICFGYKGKRKLHTVIYDSLKKLP
FPVKKIAKDFQLPLLKGDIDIHTERPVGHEITPEEYEYINKDIEIIARALDIQFKQGLDRMT
AGSDSLKGFKDILSTKKFNKVFPKLSLPMDKEIRKAYRGGFTWLNDKYKGKEIGEGMVFDIN
SAYPSQMYSRPLPYGAPIVFQGKYEKDEQYPLYIQRIRFEFELKEGYIPTIQIKKNPFFKGN
EYLKNSGVEPVELYLTNVDLELIQEHYELYNVEYIDGFKFREKTGLFKDFIDKWTYVKTHEY
GAKKQLAKLMLNSLYGKFASNPDVTGKVPYLKDDGSLGFRVGDEEYKDPVYTPMGVFIAWG
RFTTITAAQACYDRIIYCDTDSIHLTGTEVPEIIKDIVDPKKLGYWEHESTFKRAKYLRQKT
YIQDIYVKEVKGYLKQCSPDEATTTKFSVKCAGMTDTIKKKVTFDNFAVGFSSMGKPKPVQV
NGGVVLVDSVFTIK |
| H018 | 314 | MKHMPRKMYSCDFETTTDVNDCRVWAYGWMEIGKTSNYKIGTDFNEFMEWMIHSSSRLYFHD
LKFDGSFIVNWLLHNGYTWTKRPSKEGQFSTLISKMGQWYGITICSGRDGRKKKLTTIHDSL
KKLPFFVRKIGKDFKLNVLKGDIDIHKPRPIGYEIDDEEYQYIKNDIQIIAEALEVQTVQGL
TGMTNGKDALDEFVNMSGKLYEKLFPVFSLELNEEIRKAYRGGFTWLNPVYGGKKYVKDGIV
FDANSAYPSQMYDRDLPCGVPIPFEGEYVYDKSHPLYIQKLTFEFELKENYIPTIQLKNSRF
GFKGNEYLSSSNGERITISVSSVDWELIREHYHVYDVEFEKGWKFRSTKQAFRQYIDKWMLV
KNMSYGAKKAIAKLMLNSLYGKFATNPDITGKRPYLREDGSNGFELMEEEFRDPVYTPVGIF
ITSWARYTTITSAQKCYDRIIYCDTDSMHLEGLDVPESIKDIVADDVLGYWEKEGQFKQGKF
IRQKTYMEEYYAKYVRDENGEIKYDDEKPYKTICDKEESDTTIIEIKCAGMPDNIKKHVTFD
NFDIGFTMEGKLKPKQVYGGVVLVEETYTMK |
| H020 | 315 | MIKKYTGDFETTTDLNDCRVWSWGVCDIDNVDNITFGLEIDSFFEWCEMQGSTDIYFHDEKF
DGEFMLSWLFKNGFKWCKEAKEERTFSTLISNMGQWYALEICWNVKCTTTKTGKTKKEKQRT
IIYDSLKKYPFPVKEIAEAFNFPIKKGEIDITKERPIGYNPTDDEWDYLKNDIQIMAMALKI
QFDQGLTRMTRGSDALGDYQDWVKTTYGKSRFKQWFPVLSLGFDKDLRKAYKGGFTWVNKVF
QGKEIGEGIVFDANSAYPSQMYVRPLPYGTPLFYEGEYKENIDYPLYIQNIKVRFRLKERHI
PTIQVKQSSLFIQNEYLESSVNKLGVDELIDLTLTNVDLDLFFEHYDILEIHYTYGYMFKAS
CDMFKGWIDKWIEVKNTTYGARKANAKGMLNSLYGKFGTNPDITGKVPYMGEDGIVRLTLGE
EELRDPVYVPLASFVTAWGRYTTITTAQRCFDNIIYCDTDSIHLTGTEVPEAIEHLVDSKKL
GYWEHESTFQRAKFIRQKTYVEEIDGELNVKCAGMPDRIKELVTFDNFEVGFSSYGKLLPKR
TQGGVVLVDTMFTIK |
| H022 | 316 | MATKKRKAYSCDFEATTSTYSETETRVWAYGWMEIGNTSHFNIGDNLDEFMLWTSKECADLY
FHDLRYDGEFIVNWLLHKGYECNESGRPKTFDTVISKGGQWYKIAIHHEGKGTTQIFDSLKK
LPFPVKTIAKAFKLPVLKGDIDINLHRDENHVITSEEFTYIKHDIEIVARALDIQINQQGLV
KMTNGADSMDHFIKSLDKKKKVAERIYNQYFPKMSIAMDSIFRKAYRGGFTWVNPKFKGQEV
GEGMVFDANSAYPSVMYYKPLPWGKPVPFVGKYEEDPDFPLYICHIKTGFVLKEGHIPTQI
KKNPIFQENEYLETSGGAPVDLHVTNVDLELIKEHYELYDTEYVGGWKFRQQTGIFNNFIDY
WMKIKTDPKSTPAIVTLAKLQLNSLYGKFASHPDVTGKVPYLKDDGSTAFKKGLPKSKDPVY
TPAGAFITAWARHMTITTAQKVYDRILYCDTDSIHILGIDIPEAIKNDIHQKELGKWEFECM |

TABLE 3-continued

Homologous Polymerase Variants

| Name | SEQ ID NO | Sequence |
|---|---|---|
| | | FKRAKFVRQKTYVEDMYAKFMKYWEDGELNYYLKECVKEEATARLLNVKCAGMPQAVKKFVT FRTFAVGFTSDTGKLKPKHVKGGQILVDVPFTIK |
| QTD6 | 317 | MIKKYTGDFETTTDLNDCRVWSWGVCDIDNVDNITFGLEIDSFFEWCEMQGSTDIYFHDEKF DGEFMLSWLFKNGFKWCKEAKEERTFSTLISNMGQWYALEICWNVKCTTTKTGKTKKEKQRT IIYDSLKKYPFPVKEIAEAFNFPIKKGEIDYTKERPIGYNPTDDEWDYLKNDIQIMAMALKI QFDQGLTRMTRGSDALGDYQDWVKTTYGKSRFKQWFPVLSLGFDKDLRKAYKGGFTWVNKVF QGKEIGEGIVFDVNSLYPSQMYVRPLPYGTPLFYEGEYKENIDYPLYIQNIKVRFRLKERHI PTIQVKQSSLFIQNEYLESSVNKLGVDELIDLTLTNVDLDLFFEHYDILEIHYTYGYMFKAS CDMFKGWIDKWIEVKNTTEGARKANAKGMLNSLYGKFGTNPDITGKVPYMGEDGIVRLTLGE EELRDPVYVPLASFVTAWGRYTTITTAQRCFDNIIYCDTDSIHLTGTEVPEAIEHLVDSKKL GYWKHESTFQRAKFIRQKTYVEEIDGELNVKCAGMPDRIKELVTFDNFEVGFSSYGKLLPKR TQGGVVLVDTMFTIK |
| H026 | 318 | MIKKYTGDFETTTDLNDCRVWSWGVCDIDNVDNITFGLEIDSFFEWCEMQGSTDIYFHNEKF DGEFMLSWLFKNGFKWCKEAKEERTFSTLISNMGQWYALEICWNVKCTTTKTGKTKKEKQRT IIYDSLKKYPFPVKEIAEAFNFPIKKGEIDITKERPIGYNPTDDEWDYLKNDIQIMAMALKI QFDQGLTRMTRGSDALGDYQDWVKTTYGKSRFKQWFPVLSLGFDKDLRKAYKGGFTWVNKVF QGKEIGEGIVFDVNSLYPSQMYVRPLPYGTPLFYEGEYKENIDYPLYIQNIKVRFRLKERHI PTIQVKQSSLFIQNEYLESSVNKLGVDELIDLTLTNVDLDLFFEHYDILEIHYTYGYMFKAS CDMFKGWIDKWIEVKNTTEGARKANAKGMLNSLYGKFGTNPDITGKVPYMGEDGIVRLTLGE EELRDPVYVPLASFVTAWGRYTTITTAQRCFDNIIYCDTDSIHLTGTEVPEAIEHLVDSKKL GYWKHESTFQRAKFIRQKTYVEEIDGELNVKCAGMPDRIKELVTFDNFEVGFSSYGKLLPKR TQGGVVLVDTMFTIK |
| H027 | 319 | MIKKYTGDFETTTDLNDCRVWSWGVCDIDNVDNITFGLEIDSFFEWCEMQGSTDIYFHNEKF DGEFMLSWLFKNGFKWCKEAKEERTFSTLISNMGQWYALEICWNVKCTTTKTGKTKKEKQRT IIYDSLKKYPFPVKEIAEAFNFPIKKGEIDITKERPIGYNPTDDEWDYLKNDIQIMAMALKI QFDQGLTRMTRGSDALGDYQDWVKTTYGKSRFKQWFPVLSLGFDKDLRKAYKGGFTWVNKVF QGKEIGEGIVFDVNSLYPSQMYVRPLPYGTPLFYEGEYKENIDYPLYIQNIKVRFRLKERHI PTIQVKQSSLFIQNEYLESSVNKLGVDELIDLTLTNVDLDLFFEHYDILEIHYTYGYMFKAS CDMFKGWIDKWIEVKNTTEGARKANAKGMLNSLYGKFGTNPDITGKVPYMGEDGIVRLTLGE EELRDPVYVPLASFVTAWGRYTTITTAQRCFDNIIYCDTDSIHLTGTEVPEAIEHLVDSKKL GYWEHESTFQRAKFIRQKTYVEEIDGELNVKCAGMPDRIKELVTFDNFEVGFSSYGKLLPKR TQGGVVLVDTMFTIK |
| H028 | 320 | MIKKYTGDFETTTDLNDCRVWSWGVCDIDNVDNITFGLEIDSFFEWCEMQGSTDIYFHNEKF DGEFMLSWLFKNGFKWCKEAKEERTFSTLISNMGQWYALEICWNVKCTTTKTGKTKKEKQRT IIYDSLKKYPFPVKEIAEAFNFPIKKGEIDITKERPIGYNPTDDEWDYLKNDIQIMAMALKI QFDQGLTRMTRGSDALGDYQDWVKTTYGKSRFKQWFPVLSLGFDKDLRKAYKGGFTWVNKVF QGKEIGEGIVFDANSHYPSQMYVRPLPYGTPLFYEGEYKENIDYPLYIQNIKVRFRLKERHI PTIQVKQSSLFIQNEYLESSVNKLGVDELIDLTLTNVDLDLFFEHYDILEIHYTYGYMFKAS CDMFKGWIDKWIEVKNTTEGARKANAKGMLNSLYGKFGTNPDITGKVPYMGEDGIVRLTLGE EELRDPVYVPLASFVTAWGRYTTITTAQRCFDNIIYCDTDSIHLTGTEVPEAIEHLVDSKKL GYWKHESTFQRAKFIRQKTYVEEIDGELNVKCAGMPDRIKELVTFDNFEVGFSSYGKLLPKR TQGGVVLVDTMFTIK |
| H029 | 321 | MIKKYTGDFETTTDLNDCRVWSWGVCDIDNVDNITFGLEIDSFFEWCEMQGSTDIYFHNEKF DGEFMLSWLFKNGFKWCKEAKEERTFSTLISNMGQWYALEICWNVKCTTTKTGKTKKEKQRT IIYDSLKKYPFPVKEIAEAFNFPIKKGEIDITKERPIGYNPTDDEWDYLKNDIQIMAMALKI QFDQGLTRMTRGSDALGDYQDWVKTTYGKSRFKQWFPVLSLGFDKDLRKAYKGGFTWVNKVF QGKEIGEGIVFDANSAYPSQMYVRPLPYGTPLFYEGEYKENIDYPLYIQNIKVRFRLKERHI PTIQVKQSSLFIQNEYLESSVNKLGVDELIDLTLTNVDLDLFFEHYDILEIHYTYGYMFKAS CDMFKGWIDKWIEVKNTTEGARKANAKGMLNSLYGKFGTNPDITGKVPYMGEDGIVRLTLGE EELRDPVYVPLASFVTAWGRYTTITTAQRCFDNIIYCDTDSIHLTGTEVPEAIEHLVDSKKL GYWKHESTFQRAKFIRQKTYVEEIDGELNVKCAGMPDRIKELVTFDNFEVGFSSYGKLLPKR TQGGVVLVDTMFTIK |
| H030 | 322 | MIKKYTGDFETTTDLNDCRVWSWGVCDIDNVDNITFGLEIDSFFEWCEMQGSTDIYFHNEKF DGEFMLSWLFKNGFKWCKEAKEERTFSTLISNMGQWYALEICWNVKCTTTKTGKTKKEKQRT IIYDSLKKYPFPVKEIAEAFNFPIKKGEIDITKERPIGYNPTDDEWDYLKNDIQIMAMALKI QFDQGLTRMTRGSDALGDYQDWVKTTYGKSRFKQWFPVLSLGFDKDLRKAYKGGFTWVNKVF QGKEIGEGIVFDANSHYPSQMYVRPLPYGTPLFYEGEYKENIDYPLYIQNIKVRFRLKERHI PTIQVKQSSLFIQNEYLESSVNKLGVDELIDLTLTNVDLDLFFEHYDILEIHYTYGYMFKAS CDMFKGWIDKWIEVKNTTYGARKANAKGMLNSLYGKFGTNPDITGKVPYMGEDGIVRLTLGE EELRDPVYVPLASFVTAWGRYTTITTAQRCFDNIIYCDTDSIHLTGTEVPEAIEHLVDSKKL GYWKHESTFQRAKFIRQKTYVEEIDGELNVKCAGMPDRIKELVTFDNFEVGFSSYGKLLPKR TQGGVVLVDTMFTIK |
| H031 | 323 | MIKKYTGDFETTTDLNDCRVWSWGVCDIDNVDNITFGLEIDSFFEWCEMQGSTDIYFHNEKF DGEFMLSWLFKNGFKWCKEAKEERTFSTLISNMGQWYALEICWNVKCTTTKTGKTKKEKQRT IIYDSLKKYPFPVKEIAEAFNFPIKKGEIDITKERPIGYNPTDDEWDYLKNDIQIMAMALKI QFDQGLTRMTRGSDALGDYQDWVKTTYGKSRFKQWFPVLSLGFDKDLRKAYKGGFTWVNKVF QGKEIGEGIVFDANSHYPSQMYVRPLPYGTPLFYEGEYKENIDYPLYIQNIKVRFRLKERHI |

TABLE 3-continued

Homologous Polymerase Variants

| Name | SEQ ID NO | Sequence |
|---|---|---|
| | | PTIQVKQSSLFIQNEYLESSVNKLGVDELIDLTLTNVDLDLFFEHYDILEIHYTYGYMFKAS<br>CDMFKGWIDKWIEVKNTTYGARKANAKGMLNSLYGKFGTNPDITGKVPYMGEDGIVRLTLGE<br>EELRDPVYVPLASFVTAWGRYTTITTAQRCFDNIIYCDTDSIHLTGTEVPEAIEHLVDSKKL<br>GYWEHESTFQRAKFIRQKTYVEEIDGELNVKCAGMPDRIKELVTFDNFEVGFSSYGKLLPKR<br>TQGGVVLVDTMFTIK |
| H032 | 324 | MIKKYTGDFETTTDLNDCRVWSWGVCDIDNVDNITFGLEIDSFFEWCEMQGSTDIYFHNEKF<br>DGEFMLSWLFKNGFKWCKEAKEERTFSTLISNMGQWYALEICWNVKCTTTKTGKTKKEKQRT<br>IIYDSLKKYPFPVKEIAEAFNFPIKKGEIDITKERPIGYNPTDDEWDYLKNDIQIMAMALKI<br>QFDQGLTRMTRGSDALGDYQDWVKTTYGKSRFKQWFPVLSLGFDKDLRKAYKGGFTWVNKVF<br>QGKEIGEGIVFDANSHYPAQMYVRPLPYGTPLFYEGEYKENIDYPLYIQNIKVRFRLKERHI<br>PTIQVKQSSLFIQNEYLESSVNKLGVDELIDLTLTNVDLDLFFEHYDILEIHYTYGYMFKAS<br>CDMFKGWIDKWTEVKTTTYGARKQLAKLMLNSLYGKFGTNPDITGKVPYMGEDGIVRLTLGE<br>EELRDPVYVPLASFVTAWGRYTTITTAQRCFDNIIYCDTDSIHLTGTEVPEAIEHLVDPKKL<br>GYWEHESTFKRAKFIRQKTYVEEIDGELNVKCAGMPDRIKELVTFDNFEVGFSSYGKLLPKR<br>TQGGVVLVDTMFTIK |
| H033 | 325 | MIKKYTGDFETTTDLNDCRVWSWGVCDIDNVDNITFGLEIDSFFEWCEMQGSTDIYFHNEKF<br>DGEFMLSWLFKNGFKWCKEAKEERTFSTLISNMGQWYALEICWNVKCTTTKTGKTKKEKQRT<br>IIYDSLKKYPFPVKEIAEAFNFPIKKGEIDITKERPIGYNPTDDEWDYLKNDIQIMAMALKI<br>QFDQGLTRMTRGSDALGDYQDWVKTTYGKSRFKQWFPVLSLGFDKDLRKAYKGGFTWVNKVF<br>QGKEIGEGIVFDANSHYPAQMYVRPLPYGTPLFYEGEYKENIDYPLYIQNIKVRFRLKERHI<br>PTIQVKQSSLFIQNEYLESSVNKLGVDELIDLTLTNVDLDLFFEHYDILEIHYTYGYMFKAS<br>CDMFKGWIDKWIEVKNTTYGARKQNAKLMLNSLYGKFGTNPDITGKVPYMGEDGIVRLTLGE<br>EELRDPVYVPLASFVTAWGRYTTITTAQRCFDNIIYCDTDSIHLTGTEVPEAIEHLVDSKKL<br>GYWEHESTFQRAKFIRQKTYVEEIDGELNVKCAGMPDRIKELVTFDNFEVGFSSYGKLLPKR<br>TQGGVVLVDTMFTIK |
| H034 | 326 | MIKKYTGDFETTTDLNDCRVWSWGVCDIDNVDNITFGLEIDSFFEWCEMQGSTDIYFHNEKF<br>DGEFMLSWLFKNGFKWCKEAKEERTFSTLISNMGQWYALEICWNVKCTTTKTGKTKKEKQRT<br>IIYDSLKKYPFPVKEIAEAFNFPIKKGEIDITKERPIGYNPTDDEWDYLKNDIQIMAMALKI<br>QFDQGLTRMTRGSDALGDYQDWVKTTYGKSRFKQWFPVLSLGFDKDLRKAYKGGFTWVNKVF<br>QGKEIGEGIVFDVNSLYPSQMYVRPLPYGTPLFYEGEYKENIDYPLYIQNIKVRFRLKERHI<br>PTIQVKQSSLFIQNEYLESSVNKLGVDELIDLTLTNVDLDLFFEHYDILEIHYTYGYMFKAS<br>CDMFKGWIDKWIEVKNTTEGARKANAKGMLNSLYGKFGTNPDITGKVPYMGEDGIVRLTLGE<br>EELRDPVYVPLASFVTAWGRYTTITTAQRCFDNIIYCDTDSIHLTGTEVPEAIEHLVDSKKL<br>GYWKHESTFQRAKFIRQKTYVEEIYMKRVKGYLVQGSPDDYTDGELNVKCAGMPDRIKELVT<br>FDNFEVGFSSYGKLLPKRTQGGVVLVDTMFTIK |
| H037 | 327 | MGNKKRKIYSCDFETTTDVNDCRVWAYGLMEIDGKFENYKEGNNIDEFMEWTEQEQGDLYFH<br>NLRFDGEFIVNWLLHKGYRFNNTRKAGTFNAVISSMGQWYKIDIYYGREGKKVFKTSIYDSL<br>KKLPFPVKTIAKAFKLPIEKGDIDYDAPRPVGHQITPDESKYIKNDVEIIARALHSQLNTAK<br>LTKMTIGSDALDGFKHSLHKSPKVSKRMYDHHFPVISNAIHEEFKKAYRGGFTWANPKYAGK<br>VIGNGLVFDVNSLYPSVMYDKPLPYGLPVPFSGEYEYDETHPLFIQHIKCGFELKDGHIPTI<br>QIKKNFRFADNEYLHSSEGNILDLHVTNVDLALIKEHYTLYEEEYLQGYKFKQVTGLFKNYI<br>DYWSDKKINAEDPAIRQMAKLMLNSLYGKFGTSIDVTGKEVFLKEDGSTGFRKGQKEERDPV<br>YMPMGAFITAYARDVTIRTAQKCYDRILYCDTDSIHLVGTEIPEAIKDRIHDKKLGYWAHES<br>TFWRAKFIRQKTYIEDLCMRFEGEKVNGEWKFKMVEEKDITKATARELSVKCAGMPAQVKQY<br>VTFDNFGVDFKHDPNDYTDEEIKRKNIKFKLKPTHRKGGQVLVPTPFTIK |
| Q001 | 328 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWEHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q002 | 329 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q003 | 330 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK |

TABLE 3-continued

Homologous Polymerase Variants

| Name | SEQ ID NO | Sequence |
|---|---|---|
| | | KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYLGGFTWLNDRFKGKEIGEGMVF<br>DANSHYPAQMYSRLLPYGEPIVFEGKYVWDEDYPLHIQIRCEFELKEGYIPTIQIKRSRFY<br>KGNEYLKSSGGEIADLWLSNVDLELMKEHYDLYNVEYISGLKFKATTGLFKDFIDKWTYIKT<br>TSKGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q004 | 331 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGKLVQGSPDDYTDIKFSVKCAGMTDKIKKEVTFENFKVGFSRKMKPKP<br>VQVPGGVVLVDETFTIK |
| Q005 | 332 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWCHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q006 | 333 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIRQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q007 | 334 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKRLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q008 | 335 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DARSHYPAQMYSRLLPYGEPIVFEGKYVWDEDYPLHIQIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q009 | 336 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDDKKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |

TABLE 3-continued

Homologous Polymerase Variants

| Name | SEQ ID NO | Sequence |
|---|---|---|
| Q010 | 337 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q011 | 338 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPDKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q012 | 339 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAFRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q013 | 340 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDYHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSLYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSEGAIKQLAKLMLNSLYGKFASNPDVTGKVPYLKENGALGFRLGEEETKDPVYTPMGVFIT<br>AWARYTTITAAQACYDRIIYCDTDSIHLTGTEIPDVIKDIVDPKKLGYWEHESTFKRAKYLR<br>QKTYIQDIYMKEVDGKLVEGSPDDYTDIKFSVKCAGMTDKIKKEVTFENFKVGFSRKMKPKP<br>VQVPGGVVLVDDTFTIK |
| Q014 | 341 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDYHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSLYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSEGAIKQLAKLMLNSLYGKFASNPDVTGKVPYLKENGALGFRLGEEETKDPVYTPMGVFIT<br>AWARYTTITAAQACYDRIIYCDTDSIHLTGTEIPDVIKDIVDPKKLGYWCHESTFKRAKYLR<br>QKTYIQDIYMKEVDGKLVEGSPDDYTDIKFSVKCAGMTDKIKKEVTFENFKVGFSRKMKPKP<br>VQVPGGVVLVDDTFTIK |
| Q015 | 342 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDYHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSLYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSEGAIKQLAKLMLNSLYGKFASNPDVTGKVPYLKENGALGFRLGEEETKDPVYTPMGVFIT<br>AWARYTTITAAQACYDRIIYCDTDSIHLTGTEIPDVIKDIVDPKKLGYWSHESTFKRAKYLR<br>QKTYIQDIYMKEVDGKLVEGSPDDYTDIKFSVKCAGMTDKIKKEVTFENFKVGFSRKMKPKP<br>VQVPGGVVLVDDTFTIK |
| Q016 | 343 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDYHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSLYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSEGAIKQLAKLMLNSLYGKFASNPDVTGKVPYLKENGALGFRLGEEETKDPVYTPMGVFIT |

TABLE 3-continued

Homologous Polymerase Variants

| Name | SEQ ID NO | Sequence |
|---|---|---|
| | | AWARYTTITAAQACYDRIIYCDTDSIHLTGTEIPDVIKDIVDPKKLGYWTHESTFKRAKYLR QKTYIQDIYMKEVDGKLVEGSPDDYTDIKFSVKCAGMTDKIKKEVTFENFKVGFSRKMKPKP VQVPGGVVLVDDTFTIK |
| Q017 | 344 | MKHMPRKMYSCDFETTTKVEDCRVWAYGYMNIEDHSEYKIGNSLDEFMAWVLKVQADLYFHN LKFDGAFIINWLERNGFKWSADGLPNTYNTIISRMGQWYMIDICLGYKGKRKIHTVIYDSLK KLPFPVKKIAKDFKLTVLKGDIDYHKERPVGYKITPEEYAYIKNDIQIIAEALLIQFKQGLD RMTAGSDSLKGFKDIITTKKFKKVFPTLSLGLDKEVRYAYRGGFTWLNDRFKEKEIGEGMVF DVNSLYPAQMYSRLLPYGEPIVFEGKYVWDEDYPLHIQHIRCEFELKEGYIPTIQIKRSRFY KGNEYLKSSGGEIADLWLSNVDLELMKEHYDLYNVEYISGLKFKATTGLFKDFIDKWTYIKT TSEGAIKQLAKLMLNSLYGKFASNPDVTGKVPYLKENGALGFRLGEEETKDPVYTPMGVFIT AWARYTTITAAQACYDRIIYCDTDSIHLTGTEIPDVIKDIVDPKKLGYWNHESTFKRAKYLR QKTYIQDIYMKEVDGKLVEGSPDDYTDIKFSVKCAGMTDKIKKEVTFENFKVGFSRKMKPKP VQVPGGVVLVDDTFTIK |
| Q018 | 345 | MKHMPRKMYSCDFETTTKVEDCRVWAYGYMNIEDHSEYKIGNSLDEFMAWVLKVQADLYFHN LKFDGAFIINWLERNGFKWSADGLPNTYNTIISRMGQWYMIDICLGYKGKRKIHTVIYDSLK KLPFPVKKIAKDFKLTVLKGDIDYHKERPVGYKITPEEYAYIKNDIQIIAEALLIQFKQGLD RMTAGSDSLKGFKDIITTKKFKKVFPTLSLGLDKEVRYAYRGGFTWLNDRFKEKEIGEGMVF DVNSLYPAQMYSRLLPYGEPIVFEGKYVWDEDYPLHIQHIRCEFELKEGYIPTIQIKRSRFY KGNEYLKSSGGEIADLWLSNVDLELMKEHYDLYNVEYISGLKFKATTGLFKDFIDKWTYIKT TSEGAIKQLAKLMLNSLYGKFASNPDVTGKVPYLKENGALGFRLGEEETKDPVYTPMGVFIT AWARYTTITAAQACYDRIIYCDTDSIHLTGTEIPDVIKDIVDPKKLGYWQHESTFKRAKYLR QKTYIQDIYMKEVDGKLVEGSPDDYTDIKFSVKCAGMTDKIKKEVTFENFKVGFSRKMKPKP VQVPGGVVLVDDTFTIK |
| Q019 | 346 | MKHMPRKMYSCDFETTTKVEDCRVWAYGYMNIEDHSEYKIGNSLDEFMAWVLKVQADLYFHN LKFDGAFIINWLERNGFKWSADGLPNTYNTIISRMGQWYMIDICLGYKGKRKIHTVIYDSLK KLPFPVKKIAKDFKLTVLKGDIDYHKERPVGYKITPEEYAYIKNDIQIIAEALLIQFKQGLD RMTAGSDSLKGFKDIITTKKFKKVFPTLSLGLDKEVRYAYRGGFTWLNDRFKEKEIGEGMVF DVNSLYPAQMYSRLLPYGEPIVFEGKYVWDEDYPLHIQHIRCEFELKEGYIPTIQIKRSRFY KGNEYLKSSGGEIADLWLSNVDLELMKEHYDLYNVEYISGLKFKATTGLFKDFIDKWTYIKT TSEGAIKQLAKLMLNSLYGKFASNPDVTGKVPYLKENGALGFRLGEEETKDPVYTPMGVFIT AWARYTTITAAQACYDRIIYCDTDSIHLTGTEIPDVIKDIVDPKKLGYWAHESTFKRAKYLR QKTYIQDIYMKEVDGKLVEGSPDDYTDIKFSVKCAGMTDKIKKEVTFENFKVGFSRKMKPKP VQVPGGVVLVDDTFTIK |
| Q020 | 347 | MKHMPRKMYSCDFETTTKVEDCRVWAYGYMNIEDHSEYKIGNSLDEFMAWVLKVQADLYFHN LKFDGAFIINWLERNGFKWSADGLPNTYNTIISRMGQWYMIDICLGYKGKRKIHTVIYDSLK KLPFPVKKIAKDFKLTVKKGDIDIHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMVF DVNSHYPAQMYSRLLPYGEPIVFEGKYVWDEDYPLHIQHIRCEFELKEGYIPTIQIKRSRFY KGNEYLKSSGGEIADLWLSNVDLELMKEHYDLYNVEYISGLKFKATTGLFKDFIDKWFYIKT TSYGAIKQLAKLMLNSLYGKFASNPDVTGKVPYLKENGALGFRLGEEETKDPVYTPMGVFIT AWGRYTTITAAQACYDRIIYCDTDSIHLTGTEIPDVIKDIVDPKKLGYWAHESTFKRAKYLR QKTYIQDIYMKRVKGKLVQGSPDDYTDIKFSVKCAGMTDKIKKEVTFENFKVGFSRKMKPKP VQVPGGVVLVDETFTIK |
| Q021 | 348 | MKHMPRKMYSCDFETTTKVEDCRVWAYGYMNIEDHSEYKIGNSLDEFMAWVLKVQADLYFHN LKFDGAFIINWLERNGFKWSADGLPNTYNTIISRMGQWYMIDICLGYKGKRKIHTVIYDSLK KLPFPVEKIAKDFKLTVKKGDIDIHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMVF DANSHYPAQMYSRLLPYGEPIVFEGKYVWDEDYPLHIQHIRCEFELKEGYIPTIQIKRSRFY KGNEYLKSSGGEIADLWLSNVDLELMKEHYDLYNVEYISGLKFKATTGLFKDFIDKWFYIKT TSYGAIKQLAKLMLNSLYGKFASNPDVTGKVPYLKENGALGFRLGEEETKDPVYTPMGVFIT AWGRYTTITAAQACYDRIIYCDTDSIHLTGTEIPDVIKDIVDPKKLGYWNHASTFKRAKYLR QKTYIQDIYMKRVKGYLVQGSPDDYTDIKFSVKCAGMTDKIKKEVTFENFKVGFSRKMKPKP VQVPGGVVLVDETFTIK |
| Q022 | 349 | MKHMPRKMYSCDFETTTKVEDCRVWAYGYMNIEDHSEYKIGNSLDEFMAWVLKVQADLYFHN LKFDGAFIINWLERNGFKWSADGLPNTYNTIISRMGQWYMIDICLGYKGKRKIHTVIYDSLK KLPFPVEKIAKDFKLTVKKGDIDIHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMVF DANSHYPAQMYSRLLPYGEPIVFEGKYVWDEDYPLHIQHIRCEFELKEGYIPTIQIKRSRFY KGNEYLKSSGGEIADLWLSNVDLELMKEHYDLYNVEYISGLKFKATTGLFKDFIDKWFYIKT TSYGAIKQLAKLMLNSLYGKFASNPDVTGKVPYLKENGALGFRLGEEETKDPVYTPMGVFIT AWGRYTTITAAQACYDRIIYCDTDSIHLTGTEIPDVIKDIVDPKKLGYWQHASTFKRAKYLR QKTYIQDIYMKRVKGYLVQGSPDDYTDIKFSVKCAGMTDKIKKEVTFENFKVGFSRKMKPKP VQVPGGVVLVDETFTIK |
| Q023 | 350 | MKHMPRKMYSCDFETTTKVEDCRVWAYGYMNIEDHSEYKIGNSLDEFMAWVLKVQADLYFHN LKFDGAFIINWLERNGFKWSADGLPNTYNTIISRMGQWYMIDICLGYKGKRKIHTVIYDSLK KLPFPVEKIAKDFKLTVKKGDIDIHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMVF |

TABLE 3-continued

Homologous Polymerase Variants

| Name | SEQ ID NO | Sequence |
|---|---|---|
| | | DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKFGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q024 | 351 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMKSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q025 | 352 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPSQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q026 | 353 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKD<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q027 | 354 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAWKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q028 | 355 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQWAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q029 | 356 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLFLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |

TABLE 3-continued

Homologous Polymerase Variants

| Name | SEQ ID NO | Sequence |
|---|---|---|
| Q030 | 357 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKAFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q031 | 358 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>RSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q032 | 359 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWDYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKKGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q033 | 360 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHASTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q034 | 361 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSAYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWEHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q035 | 362 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAQDFKLTVKKGDIDYHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DINSAYPAQMYSRLLPYGEPIVFEGKYVWDEDYPLHIQHIRCEFELKEGYIPTIQIQSLFY<br>KGNEYLKSSGGEIADLWLSNVDLELMKEHYDLYNVEYISGLKFKATTGLFKDFIDKWTYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTKIPDVIKDIVHPKKLGYWEHESTFKRAKYLR<br>QKTYIQDIYMKRVRGYLVQGSPDDYTDIKFSVKCAGMTDKIKEEVTFENFKVGFSRKMKPKP<br>VQVPGGVVLVDSVFTIK |
| Q036 | 363 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DANSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT |

TABLE 3-continued

Homologous Polymerase Variants

| Name | SEQ ID NO | Sequence |
|---|---|---|
| | | AWGRYTTITAAQACYDRIIYCDTDSIHLTGTEIPDVIKDIVDPKKLGYWEHESTFKRAKYLR<br>QKTYIQDIYMKRVKGYLVQGSPDDYTDIKFSVKCAGMTDKIKKEVTFENFKVGFSRKMKPKP<br>VQVPGGVVLVDETFTIK |
| Q037 | 364 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DVNSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGLVQGSPDDYTDIKFSVKCAGMTDKIKKEVTFENFKVGFSRKMKPKP<br>VQVPGGVVLVDETFTIK |
| Q038 | 365 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKRVKGLVEGSPDDYTDIKFSVKCAGMTDKIKKEVTFENFKVGFSRKMKPKP<br>VQVPGGVVLVDETFTIK |
| Q039 | 366 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMVF<br>DVNSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKEVDGKLVQGSPDDYTDIKFSVKCAGMTDKIKKEVTFENFKVGFSRKMKPKP<br>VQVPGGVVLVDETFTIK |
| Q040 | 367 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKEVDGKLVEGSPDDYTDIKFSVKCAGMTDKIKKEVTFENFKVGFSRKMKPKP<br>VQVPGGVVLVDETFTIK |
| Q041 | 268 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKEVDGKLVEGSPDDYTDIKFSVKCAGMTDKIKKEVTFENFKVGFSRKMKPKP<br>VQVPGGVVLVDETFTIK |
| Q042 | 369 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKEVDGKLVEGSPDDYTDIKFSVKCAGMTDKIKKEVTFENFKVGFSRKMKPKP<br>VQVPGGVVLVDDTFTIK |
| Q043 | 370 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF |

TABLE 3-continued

Homologous Polymerase Variants

| Name | SEQ ID NO | Sequence |
|---|---|---|
| | | DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKHVDGKLVEGSPDDYTKIKFSVKCAGMTDKIKKEVTFENFKVGFSRKMKPKP<br>VQVPGGVVLVDDTFTIK |
| Q044 | 371 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKHVHGKLVEGSPDDYTKIKFSVKCAGMTDKIKKEVTFENFKVGFSRKMKPKP<br>VQVPGGVVLVDDTFTIK |
| Q045 | 372 | MKHMPRKRYSCDFETTTKVEDCRVWAYGYMNIEDHSEYKIGNSLDEFMAWALKVQADLYFHN<br>LKFDGAFIINWLERNGFKWSADGLPNTYNTIISRMGQWYMIDICLGYKGKRKIHTVIYDSLK<br>KLPFPVKKIAKDFKLTVLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKRSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKEVDGKLVEGSPDDYTDIKLSVKCAGMTDKIKKEVTFENFKVGFSRKMKPKP<br>VQVPGGVVLVDDTFTIK |
| Q046 | 373 | MKHMPRKRYSCDFETTTKVEDCRVWAYGYMNIEDHSEYKIGNSLDEFMAWALKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKHVDGKLVEGSPDDYTKIKLSVKCAGMTDKIKKEVTFENFKVGFSRKMKPKP<br>VQVPGGVVLVDDTFTIK |
| Q047 | 374 | MKHMPRKRYSCDFETTTKVEDCRVWAYGYMNIEDHSEYKIGNSLDEFMAWALKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKHVHGKLVEGSPDDYTKIKLSVKCAGMTDKIKKEVTFENFKVGFSRKMKPKP<br>VQVPGGVVLVDDTFTIK |
| Q048 | 375 | MKHMPRKRYSCDFETTTKVEDCRVWAYGYMNIEDHSEYKIGNSLDEFMAWALKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKNVNGKLVEGSPDDYTKIKLSVKCAGMTDKIKKEVTFENFKVGFSRKMKPKP<br>VQVPGGVVLVDDTFTIK |
| Q049 | 376 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT |

TABLE 3-continued

Homologous Polymerase Variants

| Name | SEQ ID NO | Sequence |
|---|---|---|
| | | TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKHVHGKLVEGSPDDYTKIKLSVKCAGMTDKIKKEVTFENFKVGFSRKMKPKP<br>VQVPGGVVLVDDTFTIK |
| Q050 | 377 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSEGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKNVNGKLVEGSPDDYTKIKLSVKCAGMTDKIKKEVTFENFKVGFSRKMKPKP<br>VQVPGGVVLVDDTFTIK |
| Q051 | 378 | MKHMPRKRYSCDFETTTKVEDCRVWAYGYMNIEDHSEYKIGNSLDEFMAWALKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKHVDGKLVEGSPDDYTKIKLSVKCAGMTDKIKKEVTFENFKVGFSRKMKPKP<br>VQVPGGVVLVDDTFTIK |
| Q052 | 379 | MKHMPRKRYSCDFETTTKVEDCRVWAYGYMNIEDHSEYKIGNSLDEFMAWALKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKHVHGKLVEGSPDDYTKIKLSVKCAGMTDKIKKEVTFENFKVGFSRKMKPKP<br>VQVPGGVVLVDDTFTIK |
| Q053 | 380 | MKHMPRKMYSCDFETTTKVEDCRVWAYGYMNIEDHSEYKIGNSLDEFMAWVLKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>QKTYIQDIYMKHVDGKLVEGSPDDYTKIKFSVKCAGMTDKIKKEVTFENFKVGFSRKMKPKP<br>VQVPGGVVLVDDTFTIK |
| Q054 | 381 | MKHMPRKRYSCDFETTTKVEDCRVWAYGYMNIEDHSEYKIGNSLDEFMAWALKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKHVHGKLVNGSPDDYTKIKLSVKCAGMTDKIKKEVTFENFKVGFSRKMKPKP<br>VQVPGGVVLVDDTFTIK |
| Q055 | 382 | MKHMPRKRYSCDFETTTKVEDCRVWAYGYMNIEDHSEYKIGNSLDEFMAWALKVQADLYFHN<br>LKFDGAFIINWLERNGFKWSADGLPNTYNTIISRMGQWYMIDICLGYKGKRKIHTVIYDSLK<br>KLPFPVKKIAKDFKLTKLKGDIDIHKERPVGYKITPEEYAYIKNDIQIIAEALLIQFKQGLD<br>RMTAGSDSLKGFKDIITTKKFKKVFPTLSLGLDKEVRYAYRGGFTWLNDRFKEKEIGEGMVF<br>DVNSHYPAQMYSRLLPYGEPIVFEGKYVWDEDYPLHIQHIRCEFELKEGYIPTIQIKNSRFY<br>KGNEYLKSSGGEIADLWLSNVDLELMKEHYDLYNVEYISGLKFKATTGLFKDFIDKWFYIKT<br>TSYGAIKQLAKLMLNSLYGKFASNPDVTGKVPYLKENGALGFRLGEEETKDPVYTPMGVFIT<br>AWGRYTTITAAQACYDRIIYCDTDSIHLTGTEIPDVIKDIVDPKKLGYWAHESTFKRAKYLR<br>PKTYIQDIYMKHVDGKLVNGSPDDYTKIKLSVKCAGMTDKIKKEVTFENFKVGFSRKMKPKP<br>VQVPGGVVLVDDTFTIK |

TABLE 4

Chimeric Polymerase Variants

| Name | SEQ ID NO | Sequence |
|---|---|---|
| C001 | 383 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEQYPLYIQRIRFEFELKEGYIPTIQIKKNP<br>FFKGNEYLKNSGVEPVELYLTNVDLELIQEHYELYNVEYIDGFKFRETTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C002 | 384 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKKNP<br>FFKGNEYLKNSGVEPVELYLTNVDLELIQEHYELYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C003 | 385 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKKNP<br>FFKGNEYLKNSGVEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C004 | 386 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRILPYGDPIVFDGKYVWDDEYPLHIQHIRCEFELKDGYIPTIQIKRSR<br>FYKGNEYLKSSGGEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C005 | 387 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRILPYGDPIVFDGKYVWDDEYPLHIQHIRCDFELKDGYIPTIQIKRSR<br>FYKGNEYLKSSGGDLVELWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C006 | 388 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRILPYGDPIVFDGKYVWDDEYPLHIQHIRCDFELKDGYIPTIQIKRSR<br>FYKGNEYLKSSGGDLVELWISQVDIDLMKEHYELYNVEYLSGIKFRATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C007 | 389 | MSRKMFSCDFETTTRLDDCRVWAYGYMEIGNLDNYKLGNSLDEFMQWVMEINADLYFHDLK<br>FDGAFLVNWLEQHGFRWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKRSR<br>FYKGNEYLKSSGGEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR |

TABLE 4-continued

Chimeric Polymerase Variants

| Name | SEQ ID NO | Sequence |
|---|---|---|
| | | AKYLRQKTYIQDIYMKRVKGYLVQGSPDDYTDIKFSVKCAGMTDKIKKEVTFENFKVGFSR<br>KMKPKPVQVPGGVVLVDETFTIK |
| C008 | 390 | MSRKMFSCDFETTTRLDDCRVWAYGYMEIGNLDNYKLGNSLDEFMQWVMEINADLYHDLK<br>FDGAFLVNWLEQHGFRWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRILPYGDPIVFDGKYVWDDEYPLHIQHIRCDFELKDGYIPTIQIKRSR<br>FYKGNEYLKSSGGDLVELWISQVDIDLMKEHYELYNVEYLSGIKFRATTGIFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C009 | 391 | MSRKMFSCDFETTTKLDDCRVWAYGYMEIGNLDNYKIGNSLDEFMQWVMEIQADLYHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRILPYGDPIVFDGKYVWDDEYPLHIQHIRCDFELKDGYIPTIQIKRSR<br>FYKGNEYLKSSGGELVELYVTNIDLDLIKEHYELYNVEYLSGLKFRATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C010 | 392 | MIKKYTGDFETTTDLNDCRVWSWGVCDIDNVDNITFGLEIDSFFEWCEMQGSTDIYFHNEK<br>FDGEFMLSWLFKNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKRSR<br>FYKGNEYLKSSGGEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C011 | 393 | MIKKYTGDFETTTDLNDCRVWSWGVCDIDNVDNITFGLEIDSFFEWCEMQGSTDIYFHNEK<br>FDGEFMLSWLFKNGFKWCKEAKEERTFSTLISNMGQWYALEICWNVKCTTTKTGKTKKEKQ<br>RTIIYDSLKKYPFPVKEIAEAFNFPIKKGEIDYTKERPIGYNPTDDEWDYLKNDIQIMAMA<br>LKIQFDQGLDRMTAGSDSLKGFKDIITTKKFKKVFPTLSLGLDKEVRKAYRGGFTWLNDRF<br>KGKEIGEGMVFDANSHYPAQMYSRLLPYGEPIVFEGKYVWDEDYPLHIQHIRCEFELKEGY<br>IPTIQIKRSRFYKGNEYLKSSGGEIADLWLSNVDLELMKEHYDLYNVEYISGLKFKATTGL<br>FKDFIDKWTYIKTTSYGAIKQLAKLMLNSLYGKFASNPDVTGKVPYLKENGALGFRLGEEE<br>TKDPVYTPMGVFITAWGRYTTITAAQACYDRIIYCDTDSIHLTGTEIPDVIKDIVDPKKLG<br>YWEHESTFKRAKYLRQKTYIQDIYMKRVKGYLVQGSPDDYTDIKFSVKCAGMTDKIKKEVT<br>FENFKVGFSRKMKPKPVQVPGGVVLVDETFTIK |
| C012 | 394 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYEGEYKENIDYPLYIQNIKVRFRLKERHIPTIQIK<br>RSRFYKGNEYLKSSGGEIADLWLSNVDLELMKEHYDLYNVEYISGLKFKATTGLFKDFIDK<br>WTYIKTTSYGAIKQLAKLMLNSLYGKFASNPDVTGKVPYLKENGALGFRLGEEETKDPVYT<br>PMGVFITAWGRYTTITAAQACYDRIIYCDTDSIHLTGTEIPDVIKDIVDPKKLGYWEHEST<br>FKRAKYLRQKTYIQDIYMKRVKGYLVQGSPDDYTDIKFSVKCAGMTDKIKKEVTFENFKVG<br>FSRKMKPKPVQVPGGVVLVDETFTIK |
| C013 | 395 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C014 | 396 | MIKKYTGDFETTTDLNDCRVWSWGVCDIDNVDNITFGLEIDSFFEWCEMQGSTDIYFHNEK<br>FDGEFMLSWLFKNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQIKRSR |

TABLE 4-continued

Chimeric Polymerase Variants

| Name | SEQ ID NO | Sequence |
|---|---|---|

FYKGNEYLKSSGGEIADLWLSNVDLELMKEHYDLYNVEYISGLKFKATTGLFKDFIDKWTY
IKTTSYGAIKQLAKLMLNSLYGKFASNPDVTGKVPYLKENGALGFRLGEEETKDPVYTPMG
VFITAWGRYTTITAAQACYDRIIYCDTDSIHLTGTEIPDVIKDIVDPKKLGYWEHESTFKR
AKYLRQKTYIQDIYMKRVKGYLVQGSPDDYTDIKFSVKCAGMTDKIKKEVTFENFKVGFSR
KMKPKPVQVPGGVVLVDETFTIK

C015 397 MIKKYTGDFETTTDLNDCRVWSWGVCDIDNVDNITFGLEIDSFFEWCEMQGSTDIYFHNEK
FDGEFMLSWLFKNGFKWCKEAKEERTFSTLISNMGQWYALEICWNVKCTTTKTGKTKKEKQ
RTIIYDSLKKYPFPVKEIAEAFNFPIKKGEIDYTKERPIGYNPTDDEWDYLKNDIQIMAMA
LKIQFDQGLDRMTAGSDSLKGFKDIITTKKFKKVFPTLSLGLDKEVRKAYRGGFTWLNDRF
KGKEIGEGMVFDANSHYPAQMYVRPLPYGTPLFYEGEYKENIDYPLYIQNIKVRFRLKERH
IPTIQVKQSSLFIQNEYLESSVNKLGVDELIDLTLTNVDLDLFFEHYDILEIHYTYGYMPK
ASCDMFKDFIDKWTYIKTTSYGAIKQLAKLMLNSLYGKFASNPDVTGKVPYLKENGALGFR
LGEEETKDPVYTPMGVFITAWGRYTTITAAQACYDRIIYCDTDSIHLTGTEIPDVIKDIVD
PKKLGYWEHESTFKRAKYLRQKTYIQDIYMKRVKGYLVQGSPDDYTDIKFSVKCAGMTDKI
KKEVTFENFKVGFSRKMKPKPVQVPGGVVLVDETFTIK

C016 398 MSRKMFSCDFETTTKLDDCRVWAYGYMEIGNLDNYKIGNSLDEFMQWVMEIQADLYFHNLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYSRLLPYGEPIVFEGKYVWDEDYPLHIQHIRCEFELKEGYIPTIQIKRSR
FYKGNEYLKSSGGEIADLWLSNVDLELMKEHYDLYNVEYISGLKFKATTGLFKDFIDKWTY
IKTTSYGAIKQLAKLMLNSLYGKFASNPDVTGKVPYLKENGALGFRLGEEETKDPVYTPMG
VFITAWGRYTTITAAQACYDRIIYCDTDSIHLTGTEIPDVIKDIVDPKKLGYWAHESTFKR
AKYLRQKTYIQDIYMKRVKGYLVQGSPDDYTDIKFSVKCAGMTDKIKKEVTFENFKVGFSR
KMKPKPVQVPGGVVLVDETFTIK

C017 399 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYSRLLPYGEPIVFEGKYVWDEDYPLHIQHIRCEFELKEGYIPTIQIKRSR
FYKGNEYLKSSGGEIADLWLSNVDLELMKEHYDLYNVEYISGLKFKATTGLFKDFIDKWTY
IKTTSYGAIKQLAKLMLNSLYGKFASNPDVTGKVPYLKENGALGFRLGEEETKDPVYTPMG
VFITAWGRYTTITAAQACYDRIIYCDTDSIHLTGTEIPDVIKDIVDPKKLGYWEHESTFKR
AKYLRQKTYIQDIYMKRVKGYLVQGSPDDYTDIKFSVKCAGMTDKIKKEVTFENFKVGFSR
KMKPKPVQVPGGVVLVDETFTIK

C018 400 MKHMPRKMYSCDFETTTKVEDCRVWAYGYMNIEDHSEYKIGNSLDEFMAWVLKVQADLYFH
DLKFDGAFIINWLERNGFKWSADGLPNTYNTIISRMGQWYMIDICLGYKGKRKIHTVIYDS
LKKLPFPVEKIAKDFKLTVKKGDIDIHKERPVGYKITPEEYAYIKNDIQIIAEALLIQFKQ
GLDRMTAGSDSLKGFKDIITTKKFKKVFPTLSLGLDKEVRKAYRGGFTWLNDRFKGKEIGE
GMVFDANSHYPAQMYSRPLPYGAPIVFQGKYEKDEQYPLYIQRIRFEFELKEGYIPTIQIK
KNPFFKGNEYLKNSGVEPVELYLTNVDLELIQEHYELYNVEYIDGFKFREKTGLFKDFIDK
WTYIKTTSYGAIKQLAKLMLNSLYGKFASNPDVTGKVPYLKENGALGFRLGEEETKDPVYT
PMGVFITAWGRYTTITAAQACYDRIIYCDTDSIHLTGTEIPDVIKDIVDPKKLGYWEHEST
FKRAKYLRQKTYIQDIYMKRVKGYLVQGSPDDYTDIKFSVKCAGMTDKIKKEVTFENFKVG
FSRKMKPKPVQVPGGVVLVDETFTIK

C019 401 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYSRPLPYGAPIVFQGKYEKDEQYPLYIQRIRFEFELKEGYIPTIQIKKNP
FFKGNEYLKNSGVEPVELYLTNVDLELIQEHYELYNVEYIDGFKFREKTGLFKDFIDKWTY
IKTTSYGAIKQLAKLMLNSLYGKFASNPDVTGKVPYLKENGALGFRLGEEETKDPVYTPMG
VFITAWGRYTTITAAQACYDRIIYCDTDSIHLTGTEIPDVIKDIVDPKKLGYWEHESTFKR
AKYLRQKTYIQDIYMKRVKGYLVQGSPDDYTDIKFSVKCAGMTDKIKKEVTFENFKVGFSR
KMKPKPVQVPGGVVLVDETFTIK

C020 402 MKHMPRKMYSCDFETTTDVNDCRVWAYGWMEIGKTSNYKIGTDFNEFMEWMIHSSSRLYFH
DLKFDGSFIVNWLLHNGYTWTKRPSKEGQFSTLISKMGQWYGITICSGRDGRKKKLTTIHD
SLKKLPFPVRKIGKDFKLNVLKGDIDYHKPRPIGYEIDDEEYQYIKNDIQIIAEALEVQTV
QGLTGMTNGSDSLKGFKDIITTKKFKKVFPTLSLGLDKEVRKAYRGGFTWLNDRFKGKEIG
EGMVFDANSHYPAQMYSRLLPYGEPIVFEGKYVWDEDYPLHIQHIRCEFELKEGYIPTIQI
KRSRFYKGNEYLKSSGGEIADLWLSNVDLELMKEHYDLYNVEYISGLKFKATTGLFKDFID
KWTYIKTTSYGAIKQLAKLMLNSLYGKFASNPDVTGKVPYLKENGALGFRLGEEETKDPVY
TPMGVFITAWGRYTTITAAQACYDRIIYCDTDSIHLTGTEIPDVIKDIVDPKKLGYWEHES
TFKRAKYLRQKTYIQDIYMKRVKGYLVQGSPDDYTDIKFSVKCAGMTDKIKKEVTFENFKV
GFSRKMKPKPVQVPGGVVLVDETFTIK

C021 403 MKHMPRKMYSCDFETTTKVEDCRVWAYGYMNIEDHSEYKIGNSLDEFMAWVLKVQADLYFH
DLKFDGAFIINWLERNGFKWSADGLPNTYNTIISRMGQWYMIDICLGYKGKRKIHTVIYDS

TABLE 4-continued

Chimeric Polymerase Variants

| Name | SEQ ID NO | Sequence |
|---|---|---|
| | | LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYDRDLPCGVPIPFEGEYVVDKSHPLYIQKLTFEFELKENYIPTIQLK<br>NSRFGFKGNEYLSSSNGERITISVSSVDWELIREHYHVYDVEFEKGWKFRSTKQAFKDFID<br>KWTYIKTTSYGAIKQLAKLMLNSLYGKFASNPDVTGKVPYLKENGALGFRLGEEETKDPVY<br>TPMGVFITAWGRYTTITAAQACYDRIIYCDTDSIHLTGTEIPDVIKDIVDPKKLGYWEHES<br>TFKRAKYLRQKTYIQDIYMKRVKGYLVQGSPDDYTDIKFSVKCAGMTDKIKKEVTFENFKV<br>GFSRKMKPKPVQVPGGVVLVDETFTIK |
| C022 | 404 | MKHMPRKMYSCDFETTTDVNDCRVWAYGWMEIGKTSNYKIGTDFNEFMEWMIHSSSRLYFH<br>DLKFDGSFIVNWLLHNGYTWTKRPSKEGQFSTLISKMGQWYGITICSGRDGRKKKLTTIHD<br>SLKKLPFPVRKIGKDFKLNVLKGDIDYHKPRPIGYEIDDEEYQYIKNDIQIIAEALEVQTV<br>QGLTGMTNGSDSLKGFKDIIITTKKFKKVFPTLSLGLDKEVRKAYRGGFTWLNDRFKGKEIG<br>EGMVFDANSHYPAQMYDRDLPCGVPIPFEGEYVVDKSHPLYIQKLTFEFELKENYIPTIQL<br>KNSRFGFKGNEYLSSSNGERITISVSSVDWELIREHYHVYDVEFEKGWKFRSTKQAFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C023 | 405 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAFRGGFTWLNDRFKGKEIGE<br>GMVFDANSHYPAQMYSRLLPYGEPIVFEGKYVWDEDYPLHIQHIRCEFELKEGYIPTIQIK<br>RSRFYKGNEYLKSSGGEIADLWLSNVDLELMKEHYDLYNVEYISGLKFKATTGLFKDFIDK<br>WTYIKTTSYGAIKQLAKLMLNSLYGKFASNPDVTGKVPYLKENGALGFRLGEEETKDPVYT<br>PMGVFITAWGRYTTITAAQACYDRIIYCDTDSIHLTGTEIPDVIKDIVDPKKLGYWAHEST<br>FKRAKYLRQKTYIQDIYMKRVKGYLVQGSPDDYTDIKFSVKCAGMTDKIKKEVTFENFKVG<br>FSRKMKPKPVQVPGGVVLVDETFTIK |
| C024 | 406 | MIKKYTGDFETTTDLNDCRVWSWGVCDIDNVDNITFGLEIDSFFEWCEMQGSTDIYFHNEK<br>FDGEFMLSWLFKNGFKWCKEAKEERTFSTLISNMGQWYALEICWNVKCTTTKTGKTKKEKQ<br>RTIIYDSLKKYPFPVKEIAEAFNPPIKKGEIDYTKERPIGYNPTDDEWDYLKNDIQIMAMA<br>LKIQFDQGLTRMTRGSDALGDFKDIITTKKFKKVFPTLSLGLDKEVRKAYRGGFTWLNDRF<br>KGKEIGEGMVFDANSHYPAQMYSRLLPYGEPIVFEGKYVWDEDYPLHIQHIRCEFELKEGY<br>IPTIQIKRSRFYKGNEYLKSSGGEIADLWLSNVDLELMKEHYDLYNVEYISGLKFKATTGL<br>FKDFIDKWTYIKTTSYGAIKQLAKLMLNSLYGKFASNPDVTGKVPYLKENGALGFRLGEEE<br>TKDPVYTPMGVFITAWGRYTTITAAQACYDRIIYCDTDSIHLTGTEIPDVIKDIVDPKKLG<br>YWEHESTFKRAKYLRQKTYIQDIYMKRVKGYLVQGSPDDYTDIKFSVKCAGMTDKIKKEVT<br>FENFKVGFSRKMKPKPVQVPGGVVLVDETFTIK |
| C025 | 407 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKRSR<br>FYKGNEYLKSSGGEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEVPEAIEHLVDSKKLGYWEHESTFQR<br>AKFIRQKTYIQDIYMKRVKGYLVQGSPDDYTDIKFSVKCAGMTDKIKKEVTFENFKVGFSR<br>KMKPKPVQVPGGVVLVDETFTIK |
| C026 | 408 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKRSR<br>FYKGNEYLKSSGGEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEVPEAIEHLVDPKKLGYWEHESTFQR<br>AKFIRQKTYIQDIYMKRVKGYLVQGSPDDYTDIKFSVKCAGMTDKIKKEVTFENFKVGFSR<br>KMKPKPVQVPGGVVLVDETFTIK |
| C027 | 409 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKRSR<br>FYKGNEYLKSSGGEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYVKKVRGYLVQCSPDEATTTKFSVKCAGMTDKIKKEVTFENFKVGFSR<br>KMKPKPVQVPGGVVLVDETFTIK |

TABLE 4-continued

Chimeric Polymerase Variants

| Name | SEQ ID NO | Sequence |
|---|---|---|
| C028 | 410 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKRSR<br>FYKGNEYLKSSGGEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEVPEAIEHLVDPKKLGYWEHESTFQR<br>AKFIRQKTYIQDIYVKKVRGYLVQCSPDEATTTKFSVKCAGMTDKIKKEVTFENFKVGFSR<br>KMKPKPVQVPGGVVLVDETFTIK |
| C029 | 411 | MIKKYTGDFETTTDLNDCRVWSWGVCDIDNVDNITFGLEIDSFFEWCEMQGSTDLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYSRLLPYGEPIVFEGKYVWDEDYPLHIQHIRCEFELKEGYIPTIQIKRSR<br>FYKGNEYLKSSGGEIADLWLSNVDLELMKEHYDLYNVEYISGLKFKATTGLFKDFIDKWTY<br>IKTTSYGAIKQLAKLMLNSLYGKFASNPDVTGKVPYLKENGALGFRLGEEETKDPVYTPMG<br>VFITAWGRYTTITAAQACYDRIIYCDTDSIHLTGTEIPDVIKDIVDPKKLGYWEHESTFKR<br>AKYLRQKTYIQDIYMKRVKGYLVQGSPDDYTDIKFSVKCAGMTDKIKKEVTFENFKVGFSR<br>KMKPKPVQVPGGVVLVDETFTIK |
| C030 | 412 | MIKKYTGDFETTTDLNDCRVWSWGVCDIDNVDNITFGLEIDSFFEWCEMQGSTDIYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C031 | 413 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICFGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C032 | 414 | MVRQSTIASPARGGVRRSHKKVPSFCADFETTTDEDDCRVWSWGIIQVGKLQNYVDGISLD<br>GFMSHISERASHIYFHDLKFDGAFIINWLERNGFKWSADGLPNTYNTIISRMGQWYMIDIC<br>LGYKGKRKIHTVIYDSLKKLPFPVEKIAKDFKLTVKKGDIDIHKERPVGYKITPEEYAYIK<br>NDIQIIAEALLIQFKQGLDRMTAGSDSLKGFKDIITTKKFKKVFPTLSLGLDKEVRKAYRG<br>GFTWLNDRFKGKEIGEGMVFDANSHYPAQMYVRPLPYGTPLFYEGEYKENIDYPLYIQNIK<br>VRFRLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIKFSV<br>KCAGMTDKIKKEVTFENFKVGFSRKMKPKPVQVPGGVVLVDETFTIK |
| C033 | 415 | MNEYISDFETQKDPDTGVMSVWAWSIVDVNDLSNIQYGNNIESWLSAIQGLPNGSLIGFHD<br>LKFDGAFIINWLERNGFKWSADGLPNTYNTIISRMGQWYMIDICLGYKGKRKIHTVIYDSL<br>KKLPFPVEKIAKDFKLTVKKGDIDIHKERPVGYKITPEEYAYIKNDIQIIAEALLIQFKQG<br>LDRMTAGSDSLKGFKDIITTKKFKKVFPTLSLGLDKEVRKAYRGGFTWLNDRFKGKEIGEG<br>MVFDANSHYPAQMYVRPLPYGTPLFYEGEYKENIDYPLYIQNIKVRFRLKERHIPTIQVKQ<br>SSLFIQNEYLESSVNKLGVDELIDLTLTNVDLDLFFEHYDILEIHYTYGYMFKASCDMFKD<br>FIDKWTYIKTTSYGAIKQLAKLMLNSLYGKFASNPDVTGKVPYLKENGALGFRLGEEETKD<br>PVYTPMGVFITAWGRYTTITAAQACYDRIIYCDTDSIHLTGTEIPDVIKDIVDPKKLGYWE<br>HESTFKRAKYLRQKTYIQDIYMKRVKGYLVQGSPDDYTDIKFSVKCAGMTDKIKKEVTFEN<br>FKVGFSRKMKPKPVQVPGGVVLVDETFTIK |
| C034 | 416 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV |

TABLE 4-continued

Chimeric Polymerase Variants

| Name | SEQ ID NO | Sequence |
|---|---|---|
| | | YTPMGVFITAWGRYTTITAAQACYDRIIYCDTDSIHLTGTEIPDVIKDIVDPKKLGYWEHE STFKRAKYLRQKTYIQDIYMKRVKGYLVQGSPDDYTDIKFSVKCAGMTDKIKKEVTFENFK VGFSRKMKPKPVQVPGGVVLVDETFTIK |
| C035 | 417 | MKHMPRKMYSCDFETTTKVEDCRVWAYGYMNIEDHSEYKIGNSLDEFMAWVLKVQADLYFH NLKFDGAFIINWLERNGFKWSADGLPNTYNTIISRMGQWYMIDICLGYKGKRKIHTVIYDS LKKLPFPVEKIAKDFKLTVKKGDIDIHKERPVGYKITPEEYAYIKNDIQIIAEALLIQFKQ GLDRMTAGSDSLKGFKDIITTKKFKKVFPTLSLGLDKEVRKAYRGGFTWLNDRFKGKEIGE GMVFDANSHYPAQMYVRPLPYGTPLFYEGEYKENIDYPLYIQNIKVRFRLKERHIPTIQVK QSSLFIQNEYLESSVNKLGVDELIDLTLTNVDLDLFFEHYDILEIHYTYGYMFKASCDMFK GWIDKWIEVKNTTEGARKANAKGMLNSLYGKFGTNPDVTGKVPYLKENGALGFRLGEEETK DPVYTPMGVFITAWGRYTTITAAQACYDRIIYCDTDSIHLTGTEIPDVIKDIVDPKKLGYW EHESTFKRAKYLRQKTYIQDIYMKRVKGYLVQGSPDDYTDIKFSVKCAGMPDRIKELVTFD NFEVGFSSYGKLLPKRTQGGVVLVDTMFTIK |
| C036 | 418 | MKHMPRKMYSCDFETTTKVEDCRVWAYGYMNIEDHSEYKIGNSLDEFMAWVLKVQADLYFH NLKFDGAFIINWLERNGFKWSADGLPNTYNTIISRMGQWYMIDICLGYKGKRKIHTVIYDS LKKLPFPVEKIAKDFKLTVKKGDIDIHKERPVGYKITPEEYAYIKNDIQIIAEALLIQFKQ GLDRMTAGSDSLKGFKDIITTKKFKKVFPTLSLGLDKEVRKAYRGGFTWLNDRFKGKEIGE GMVFDANSHYPAQMYVRPLPYGTPLFYEGEYKENIDYPLYIQNIKVRFRLKERHIPTIQVK QSSLFIQNEYLESSVNKLGVDELIDLTLTNVDLDLFFEHYDILEIHYTYGYMFKASCDMFK DFIDKWTYIKTTSYGAIKQLAKLMLNSLYGKFGTNPDITGKVPYMGEDGIVRLTLGEEELR DPVYTPMGVFITAWGRYTTITAAQACYDRIIYCDTDSIHLTGTEIPDVIKDIVDPKKLGYW EHESTFKRAKYLRQKTYIQDIYMKRVKGYLVQGSPDDYTDIKFSVKCAGMPDRIKELVTFD NFEVGFSSYGKLLPKRTQGGVVLVDTMFTIK |
| C037 | 419 | MKHMPRKMYSCDFETTTKVEDCRVWAYGYMNIEDHSEYKIGNSLDEFMAWVLKVQADLYFH NLKFDGAFINWLERNGFKWSADGLPNTYNTIISRMGQWYMIDICLGYKGKRKIHTVIYDS LKKLPFPVEKIAKDFKLTVKKGDIDIHKERPVGYKITPEEYAYIKNDIQIIAEALLIQFKQ GLDRMTAGSDSLKGFKDIITTKKFKKVFPTLSLGLDKEVRKAYRGGFTWLNDRFKGKEIGE GMVFDANSHYPAQMYSRLLPYGEPIYSEGAPRTNRPLYIASITFTAKLKPNHIPCIQIKKN LSFNPTQYLEEVKEPTTVVATNIDIELWKKHYDFKITYSWNGTFEFRGSHGFFKDFIDKWTY IKTTSYGAIKQLAKLMLNSLYGKFASNPDVTGKVPYLKENGALGFRLGEEETKDPVYTPMG VFITAWGRYTTITAAQACYDRIIYCDTDSIHLTGTEIPDVIKDIVDPKKLGYWEHESTFKR AKYLRQKTYIQDIYMKRVKGYLVQGSPDDYTDIKFSVKCAGMTDKIKKEVTFENFKVGFSR KMKPKPVQVPGGVVLVDETFTIK |
| C038 | 420 | MKHMPRKMYSCDFETTTKVEDCRVWAYGYMNIEDHSEYKIGNSLDEFMAWVLKVQADLYFH NLKFDGAFIINWLERNGFKWSADGLPNTYNTIISRMGQWYMIDICLGYKGKRKIHTVIYDS LKKLPFPVEKIAKDFKLTVKKGDIDIHKERPVGYKITPEEYAYIKNDIQIIAEALLIQFKQ GLDRMTAGSDSLKGFKDIITTKKFKKVFPTLSLGLDKEVRKAYRGGFTWLNDRFKGKEIGE GMVFDANSHYPAQMYSRLPIGTPVFFEGKYKDDPIYPLYIQFITAQFELKKGKIPTIQIK NDKRFNPREYVTSTGCLMVNLYLTNVDLEMFYECYNIKEIQYIGGYKFIGRSGIFKDFIDK WTYIKTTSYGAIKQLAKLMLNSLYGKFASNPDVTGKVPYLKENGALGFRLGEEETKDPVYT PMGVFITAWGRYTTITAAQACYDRIIYCDTDSIHLTGTEIPDVIKDIVDPKKLGYWEHEST FKRAKYLRQKTYIQDIYMKRVKGYLVQGSPDDYTDIKFSVKCAGMTDKIKKEVTFENFKVG FSRKMKPKPVQVPGGVVLVDETFTIK |
| C039 | 421 | MSRKMFSCDFETTTKLDDCRVWAYGYMEIGNLDNYKIGNSLDEFMQWVMEIQADLYFHDLK FDGAFIVNWLEQHGFKWSNEGLPNTYNTIISRMGQWYMIDICLGYKGKRKIHTVIYDSLKK LPFPVEKIAKDFKLTVKKGDIDIHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMV FDANSHYPAQMYVRPLPYGTPLFYEGEYKENIDYPLYIQNIKVRFRLKERHIPTIQVKQSS LFIQNEYLESSVNKLGVDELIDLTLTNVDLDLFFEHYDILEIHYTYGYMPKASCDMFKDFI DKWTYIKTTSYGAIKQLAKLMLNSLYGKFASNPDVTGKVPYLKENGALGFRLGEEETKDPV YTPMGVFITAWGRYTTITAAQACYDRIIYCDTDSIHLTGTEIPDVIKDIVDPKKLGYWEHE STFKRAKYLRQKTYIQDIYMKRVKGYLVQGSPDDYTDIKFSVKCAGMTDKIKKEVTFENFK VGFSRKMKPKPVQVPGGVVLVDETFTIK |
| C040 | 422 | MSRKMFSCDFETTTKLDDCRVWAYGYMEIGNLDNYKIGNSLDEFMQWVMEIQADLYFHDLK FDGAFIVNWLEQHGFKWSNEGLPNTYNTIISRMGQWYMIDICLGYKGKRKIHTVIYDSLKK LPFPVKKIAKDFQLPLLKGDIDYHTERPVGHEITPEEYEYIKNDIEIIARALDIQFKQGLD RMTAGSDLKGFKDIITTKKFKKVFPTLSLGLDKEVRKAYRGGFTWLNDRFKGKEIGEGMV FDANSHYPAQMYVRPLPYGTPLFYEGEYKENIDYPLYIQNIKVRFRLKERHIPTIQVKQSS LFIQNEYLESSVNKLGVDELIDLTLTNVDLDLFFEHYDILEIHYTYGYMFKASCDMFKDFI DKWTYIKTTSYGAIKQLAKLMLNSLYGKFASNPDVTGKVPYLKENGALGFRLGEEETKDPV YTPMGVFITAWGRYTTITAAQACYDRIIYCDTDSIHLTGTEIPDVIKDIVDPKKLGYWEHE STFKRAKYLRQKTYIQDIYMKRVKGYLVQGSPDDYTDIKFSVKCAGMTDKIKKEVTFENFK VGFSRKMKPKPVQVPGGVVLVDETFTIK |
| C041 | 423 | MSRKMFSCDFETTTKLDDCRVWAYGYMEIGNLDNYKIGNSLDEFMQWVMEIQADLYFHDLK FDGAFIVNWLERNGFKWSNEGLPNTYNTIISKMGQWYMIDICIGYKGKRKLHTVIYDSLKK LPFPVEKIAKDFKLTVKKGDIDIHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMV |

TABLE 4-continued

Chimeric Polymerase Variants

| Name | SEQ ID NO | Sequence |
|---|---|---|
| | | FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C042 | 424 | MSRKMFSCDFETTTKLDDCRVWAYGYMEIGNLDNYKIGNSLDEFMQWVMEIQADLYFHDLK<br>FDGAFIVNWLERNGFKWSNEGLPNTYNTIISKMGQWYMIDICIGYKGKRKLHTVIYDSLKK<br>LPFPVEKIAKDFQLTLKKGDIDIHKERPVGYEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C043 | 425 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYVKEVDGKLKECSPDEATDIKFSVKCAGMTDKIKKEVTFENFK<br>VGFSRKMKPKPVQVPGGVVLVDETFTIK |
| C044 | 426 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYVKRVDGYLVECSPDEYTDIKFSVKCAGMTDKIKKEVTFENFK<br>VGFSRKMKPKPVQVPGGVVLVDETFTIK |
| C045 | 427 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YVPLASFVTAWGRYTTITTAQRCFDNIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C046 | 428 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C047 | 429 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV |

TABLE 4-continued

Chimeric Polymerase Variants

| Name | SEQ ID NO | Sequence |
|---|---|---|
| | | YVPLASFVTAWGRYTTITTAQRCFDNIIYCDTDSIHLTGTEIPDVIKDIVDPKKLGYWEHE<br>STFKRAKYLRQKTYIQDIYVKEVDGKLKECSPDEATDIKFSVKCAGMTDKIKKEVTFENFK<br>VGFSRKMKPKPVQVPGGVVLVDETFTIK |
| C048 | 430 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTEIPDVIKDIVDPKKLGYWEHE<br>STFKRAKYLRQKTYIQDIYVKEVDGKLKECSPDEATDIKFSVKCAGMTDKIKKEVTFENFK<br>VGFSRKMKPKPVQVPGGVVLVDETFTIK |
| C049 | 431 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YVPLASFVTAWGRYTTITTAQRCFDNIIYCDTDSIHLTGTEIPDVIKDIVDPKKLGYWEHE<br>STFKRAKYLRQKTYIQDIYVKRVDGYLVECSPDEYTDIKFSVKCAGMTDKIKKEVTFENFK<br>VGFSRKMKPKPVQVPGGVVLVDETFTIK |
| C050 | 432 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTEIPDVIKDIVDPKKLGYWEHE<br>STFKRAKYLRQKTYIQDIYVKRVDGYLVECSPDEYTDIKFSVKCAGMTDKIKKEVTFENFK<br>VGFSRKMKPKPVQVPGGVVLVDETFTIK |
| C051 | 433 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYVKEVDGKLKECSPDEATDIKFSVKCAGMTDKIKKEVTFENFK<br>VGFSRKMKPKPVQVPGGVVLVDETFTIK |
| C052 | 434 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYVKRVDGYLVECSPDEYTDIKFSVKCAGMTDKIKKEVTFENFK<br>VGFSRKMKPKPVQVPGGVVLVDETFTIK |
| C053 | 435 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YVPLASFVTAWGRYTTITTAQRCFDNIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C054 | 436 | MSRKMFSCDFETTTKLDDCRVWAYGYMEIGNLDNYKIGNSLDEFMQWVMEIQADLYFHDLK<br>FDGAFIVNWLEQHGFKWSNEGLPNTYNTIISKMGQWYMIDICFGYKGKRKLHTVIYDSLKK<br>LPFPVKKIAKDFQLPLLKGDIDYHTERPVGHEITPEEYEYIKNDIEIIARALDIQFKQGLD<br>RMTAGSDSLKGFKDIITTKKFKKVFPTLSLGLDKEVRKAYRGGFTWLNDRFKGKEIGEGMV |

TABLE 4-continued

Chimeric Polymerase Variants

| Name | SEQ ID NO | Sequence |
|---|---|---|

FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YTPLASFVTAWGRYTTITTAQACYDRIIYCDTDSIHLTGTEIPDVIKDIVDPKKLGYWEHE
STFKRAKYLRQKTYIQDIYMKRVKGYLVQGSPDDYTDIKFSVKCAGMTDKIKKEVTFENFK
VGFSRKMKPKPVQVPGGVVLVDETFTIK

C055 437 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKEVDGKLKECSPDEATDIKFSVKCAGMTDKIKKEVTFENFK
VGFSRKMKPKPVQVPGGVVLVDETFTIK

C056 438 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YTPLASFVTAWGRYTTITTAQACYDRIIYCDTDSIHLTGTEIPDVIKDIVDPKKLGYWEHE
STFKRAKYLRQKTYIQDIYVKEVDGKLKECSPDEATDIKFSVKCAGMTDKIKKEVTFENFK
VGFSRKMKPKPVQVPGGVVLVDETFTIK

C057 439 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKRVDGYLVECSPDEYTDIKFSVKCAGMTDKIKKEVTFENFK
VGFSRKMKPKPVQVPGGVVLVDETFTIK

C058 440 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YTPLASFVTAWGRYTTITTAQACYDRIIYCDTDSIHLTGTEIPDVIKDIVDPKKLGYWEHE
STFKRAKYLRQKTYIQDIYVKRVDGYLVECSPDEYTDIKFSVKCAGMTDKIKKEVTFENFK
VGFSRKMKPKPVQVPGGVVLVDETFTIK

C059 441 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFGTNPDITGKVPYMGEDGIVRLTLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKRVDGYLVECSPDEYTDIKFSVKCAGMPDRIKELVTFDNFE
VGFSSYGKLLPKRTQGGVVLVDTMFTIK

C060 442 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI

TABLE 4-continued

Chimeric Polymerase Variants

| Name | SEQ ID NO | Sequence |
|---|---|---|

DKWTYIKTTSYGAIKQLAKLMLNSLYGKFGTNPDITGKVPYMGEDGIVRLTLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKRVDGYLVECSPDEYTDIKFSVKCAGMTDKIKKEVTFENFK
VGFSRKMKPKPVQVPGGVVLVDETFTIK

C061 443 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKRVDGYLVECSPDEYTDIKFSVKCAGMPDRIKELVTFDNFE
VGFSSYGKLLPKRTQGGVVLVDTMFTIK

C062 444 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFGTNPDITGKVPYMGEDGIVRLTLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKEVDGKLKECSPDEATDIKFSVKCAGMPDRIKELVTFDNFE
VGFSSYGKLLPKRTQGGVVLVDTMFTIK

C063 445 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFGTNPDITGKVPYMGEDGIVRLTLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKEVDGKLKECSPDEATDIKFSVKCAGMTDKIKKEVTFENFK
VGFSRKMKPKPVQVPGGVVLVDETFTIK

C064 446 MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKEVDGKLKECSPDEATDIKFSVKCAGMPDRIKELVTFDNFE
VGFSSYGKLLPKRTQGGVVLVDTMFTIK

C065 447 MKHMPRKMYSCDFETTTKVEDCRVWAYGYMNIEDHSEYKIGNSLDEFMAWVLKVQADLYFH
NLKFDGAFIINWLERNGFKWSADGLPNTYNTIISRMGQWYMIDICLGYKGKRKIHTVIYDS
LKKLPFPVEKIAKDFKLTVKKGDIDIHKERPVGYKITPEEYAYIKNDIQIIAEALLIQFKQ
GLDRMTAGSDSLKGFKDIITTKKFKKVFPTLSLGLDKEVRKAYRGGFTWLNDRFKGKEIGE
GMVFDANSHYPAQMYVRPLPYGTPLFYQGEYKENIDHPLYIQNLKVRFRLKERHIPTIQVK
QNSLFIQNEYLENSVNKLGVDELIDLTLTNVDLDLFFEHYEILEIHFTYGYMFRASCDMFK
DFIDKWTYIKTTSYGAIKQLAKLMLNSLYGKFASNPDVTGKVPYLKENGALGFRLGEEETK
DPVYTPMGVFITAWGRYTTITAAQACYDRIIYCDTDSIHLTGTEIPDVIKDIVDPKKLGYW
EHESTFKRAKYLRQKTYIQDIYMKRVKGYLVQGSPDDYTDIKFSVKCAGMTDKIKKEVTFE
NFKVGFSRKMKPKPVQVPGGVVLVDETFTIK

C066 448 MKHMPRKMYSCDFETTTKVEDCRVWAYGYMNIEDHSEYKIGNSLDEFMAWVLKVQADLYFH
NLKFDGAFIINWLERNGFKWSADGLPNTYNTIISRMGQWYMIDICLGYKGKRKIHTVIYDS
LKKLPFPVEKIAKDFKLTVKKGDIDIHKERPVGYKITPEEYAYIKNDIQIIAEALLIQFKQ
GLDRMTAGSDSLKGFKDIITTKKFKKVFPTLSLGLDKEVRKAYRGGFTWLNDRFKGKEIGE
GMVFDANSHYPAQMYVRPLPYGTPLFYEGEYKENIDYPLYIQNIKVRFRLKERHIPCIQVK
QSSLFIQTEYLESSVNKLGVDELIELTLTNVDLDLFFEHYEILEIHFTYGYMFRGSCDMFK
DFIDKFTYIKTTSYGAIKQLAKLMLNSLYGKFASNPDVTGKVPYLKENGALGFRLGEEETK
DPVYTPMGVFITAWGRYTTITAAQACYDRIIYCDTDSIHLTGTEIPDVIKDIVDPKKLGYW
EHESTFKRAKYLRQKTYIQDIYMKRVKGYLVQGSPDDYTDIKFSVKCAGMTDKIKKEVTFE
NFKVGFSRKMKPKPVQVPGGVVLVDETFTIK

C067 449 MKHMPRKMYSCDFETTTKVEDCRVWAYGYMNIEDHSEYKIGNSLDEFMAWVLKVQADLYFH
NLKFDGAFIINWLERNGFKWSADGLPNTYNTIISRMGQWYMIDICLGYKGKRKIHTVIYDS
LKKLPFPVEKIAKDFKLTVKKGDIDIHKERPVGYKITPEEYAYIKNDIQIIAEALLIQFKQ

TABLE 4-continued

Chimeric Polymerase Variants

| Name | SEQ ID NO | Sequence |
|---|---|---|
| | | GLDRMTAGSDSLKGFKDIITTKKFKKVFPTLSLGLDKEVRKAYRGGFTWLNDRFKGKEIGE<br>GMVFDANSHYPAQMYVRPLPYGTPLFYQGEYKENIQYPLYIQNIKVRFRLKERHIPTIQVK<br>QNSLFIQNEYLENSVNKLGVDELIELTLTNVDLDLFFEHYEILEIHYTYGYMFRGSCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C068 | 450 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYEGEYKENIDHPLYIQNLKVRFRLKERHIPCIQVK<br>QSSLFIQTEYLESSVNKLGVDELIELTLTNVDLDLFFEHYEILEIHYTYGYMFRGSCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C069 | 451 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYQGEYKENIQYPLYIQNIKVRFRLKERHIPTIQVK<br>QNSLFIQTEYLENSVNKLGVDELIDLTVTNVDLDLFFEHYDILEIHFTYGYMFKASCDMFK<br>DFIDKFTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C070 | 452 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYEGEYKENIDHPLYIQNLKVRFRLKERHIPCIQVK<br>QSSLFIQTEYLESSVNKLGVDELIDLTVTNVDLDLFFEHYDILEIHFTYGYMFKASCDMFK<br>DFIDKFTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C071 | 453 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYQGEYKENIQHPLYIQNLKVRFRLKERHIPCIQVK<br>QNSLFIQTEYLENSVNKLGVDELIELTVTNVDLDLFFEHYEILEIHFTYGYMFRGSCDMFK<br>DFIDKFTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C072 | 454 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYQGEYKENIQYPLYIQNLKVRFRLKERHIPTIQVK<br>QNSLFIQTEYLENSVNKLGVDELIELTVTNVDLDLFFEHYEILEIHFTYGYMFRASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C073 | 455 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIDYPLYIQNIKVRFRLKERHIPCIQVKQSS<br>LFIQNEYLESSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |

TABLE 4-continued

Chimeric Polymerase Variants

| Name | SEQ ID NO | Sequence |
|---|---|---|
| C074 | 456 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQYPLYIQNIKVRFRLKERHIPTIQVKQNS<br>LFIQNEYLENSVNKLGVDELIDLTVTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C075 | 457 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQYPLYIQNIKVRFRLKERHIPTIQVKQNS<br>LFIQNEYLENSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C076 | 458 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C077 | 459 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIDLTVTNVDLDLFFEHYDILEIHYTYGYMFKASCDMFKDFI<br>DKFTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C078 | 460 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIDHPLYIQNLKVRFRLKERHIPTIQVKQNS<br>LFIQNEYLENSVNKLGVDELIDLTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C079 | 461 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQHPLYIQNLKVRFRLKERHIPTIQVKQNS<br>LFIQNEYLENSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C080 | 462 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQYPLYIQNLKVRFRLKERHIPCIQVKQNS<br>LFIQNEYLENSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE |

TABLE 4-continued

Chimeric Polymerase Variants

| Name | SEQ ID NO | Sequence |
|---|---|---|
| | | STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C081 | 463 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQYPLYIQNLKVRFRLKERHIPTIQVKQNS<br>LFIQNEYLENSVNKLGVDELIELTVTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C082 | 464 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQHPLYIQNLKVRFRLKERHIPCIQVKQNS<br>LFIQNEYLENSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C083 | 465 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQHPLYIQNLKVRFRLKERHIPCIQVKQNS<br>LFIQNEYLENSVNKLGVDELIELTVTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C084 | 466 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQHPLYIQNLKVRFRLKERHIPCIQVKQNS<br>LFIQNEYLENSVNKLGVDELIELTLTNVDLDLFFEHYEILEIHFTYGYMFRASCDMFKDFI<br>DKFTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C085 | 467 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYQGEYKENIQHPLYIQNLKVRFRLKERHIPCIQVK<br>QNSLFIQNEYLENSVNKLGVDELIELTLTNVDLDLFFEHYEILEIHYTYGYMFRASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C086 | 468 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYQGEYKENIQHPLYIQNLKVRFRLKERHIPCIQVK<br>QNSLFIQNEYLENSVNKLGVDELIELTVTNVDLDLFFEHYEILEIHYTYGYMFRASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C087 | 469 | MSRKMFSCDFETTTKLDDCRVWAYGYMEIGNLDNYKIGNSLDEFMQWVMEIQADLYFHDLK<br>FDGAFIVNWLERNGFKWSNEGLPNTYNTIISKMGQWYMIDICIGYKGKRKLHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQYPLYIQNLKVRFRLKERHIPTIQVKQNS |

TABLE 4-continued

Chimeric Polymerase Variants

| Name | SEQ ID NO | Sequence |
|---|---|---|
| | | LFIQNEYLENSVNKLGVDELIELTLTNVDLDLFFEHYEILEIHYTYGYMFRASCDMFKDFI
DKWTYIKTTSYGAIKQLAKLMLNSLYGKFASNPDVTGKVPYLKENGALGFRLGEEETKDPV
YTPMGVFITAWGRYTTITAAQACYDRIIYCDTDSIHLTGTEIPDVIKDIVDPKKLGYWEHE
STFKRAKYLRQKTYIQDIYMKRVKGYLVQGSPDDYTDIKFSVKCAGMTDKIKKEVTFENFK
VGFSRKMKPKPVQVPGGVVLVDETFTIK |
| C088 | 470 | MSRKMFSCDFETTTKLDDCRVWAYGYMEIGNLDNYKIGNSLDEFMQWVMEIQADLYFHDLK
FDGAFIINWLERNGFKWSADGLPNTYNTIISRMGQWYMIDICLGYKGKRKIHTVIYDSLKK
LPFPVEKIAKDFKLTVKKGDIDIHKERPVGYKITPEEYAYIKNDIQIIAEALLIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYQGEYKENIQYPLYIQNLKVRFRLKERHIPTIQVKQNS
LFIQNEYLENSVNKLGVDELIELTLTNVDLDLFFEHYEILEIHYTYGYMFRASCDMFKDFI
DKWTYIKTTSYGAIKQLAKLMLNSLYGKFASNPDVTGKVPYLKENGALGFRLGEEETKDPV
YTPLASFVTAWGRYTTITTAQACYDRIIYCDTDSIHLTGTEIPDVIKDIVDPKKLGYWEHE
STFKRAKYLRQKTYIQDIYVKEVDGKLKECSPDEATDIKFSVKCAGMTDKIKKEVTFENFK
VGFSRKMKPKPVQVPGGVVLVDETFTIK |
| C089 | 471 | MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYQGEYKENIQYPLYIQNLKVRFRLKERHIPTIQVKQNS
LFIQNEYLENSVNKLGVDELIELTLTNVDLDLFFEHYEILEIHYTYGYMFRASCDMFKDFI
DKWTYIKTTSYGAIKQLAKLMLNSLYGKFASNPDVTGKVPYLKENGALGFRLGEEETKDPV
YVPLASFVTAWGRYTTITTAQRCFDNIIYCDTDSIHLTGTEIPDVIKDIVDPKKLGYWEHE
STFKRAKYLRQKTYIQDIYVKRVDGYLVECSPDEYTDIKFSVKCAGMTDKIKKEVTFENFK
VGFSRKMKPKPVQVPGGVVLVDETFTIK |
| C090 | 472 | MSRKMFSCDFETTTKLDDCRVWAYGYMEIGNLDNYKIGNSLDEFMQWVMEIQADLYFHDLK
FDGAFIVNWLEQHGFKWSNEGLPNTYNTIISKMGQWYMIDICFGYKGKRKLHTVIYDSLKK
LPFPVKKIAKDFQLPLLKGDIDYHTERPVGHEITPEEYEYIKNDIEIIARALDIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYQGEYKENIQYPLYIQNLKVRFRLKERHIPTIQVKQNS
LFIQNEYLENSVNKLGVDELIELTLTNVDLDLFFEHYEILEIHYTYGYMFRASCDMFKDFI
DKWTYIKTTSYGAIKQLAKLMLNSLYGKFASNPDVTGKVPYLKENGALGFRLGEEETKDPV
YTPLASFVTAWGRYTTITTAQACYDRIIYCDTDSIHLTGTEIPDVIKDIVDPKKLGYWEHE
STFKRAKYLRQKTYIQDIYVKRVDGYLVECSPDEYTDIKFSVKCAGMTDKIKKEVTFENFK
VGFSRKMKPKPVQVPGGVVLVDETFTIK |
| C091 | 473 | MSRKMFSCDFETTTKLDDCRVWAYGYMEIGNLDNYKIGNSLDEFMQWVMEIQADLYFHNLK
FDGAFIINWLERNGFKWSADGLPNTYNTIISRMGQWYMIDICLGYKGKRKIHTVIYDSLKK
LPFPVEKIAKDFKLTVKKGDIDIHKERPVGYKITPEEYAYIKNDIQIIAEALLIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYQGEYKENIDHPLYIQNLKVRFRLKERHIPTIQVKQNS
LFIQNEYLENSVNKLGVDELIDLTLTNVDLDLFFEHYEILEIHFTYGYMFRASCDMFKDFI
DKWTYIKTTSYGAIKQLAKLMLNSLYGKFASNPDVTGKVPYLKENGALGFRLGEEETKDPV
YTPMGVFITAWGRYTTITAAQACYDRIIYCDTDSIHLTGTEIPDVIKDIVDPKKLGYWEHE
STFKRAKYLRQKTYIQDIYMKRVKGYLVQGSPDDYTDIKFSVKCAGMTDKIKKEVTFENFK
VGFSRKMKPKPVQVPGGVVLVDETFTIK |
| C092 | 474 | MSRKMFSCDFETTTKLDDCRVWAYGYMEIGNLDNYKIGNSLDEFMQWVMEIQADLYFHNLK
FDGAFIINWLERNGFKWSADGLPNTYNTIISRMGQWYMIDICLGYKGKRKIHTVIYDSLKK
LPFPVEKIAKDFKLTVKKGDIDIHKERPVGYKITPEEYAYIKNDIQIIAEALLIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPCIQVKQSS
LFIQTEYLESSVNKLGVDELIELTLTNVDLDLFFEHYEILEIHYTYGYMFRGSCDMFKDFI
DKFTYIKTTSYGAIKQLAKLMLNSLYGKFASNPDVTGKVPYLKENGALGFRLGEEETKDPV
YTPMGVFITAWGRYTTITAAQACYDRIIYCDTDSIHLTGTEIPDVIKDIVDPKKLGYWEHE
STFKRAKYLRQKTYIQDIYMKRVKGYLVQGSPDDYTDIKFSVKCAGMTDKIKKEVTFENFK
VGFSRKMKPKPVQVPGGVVLVDETFTIK |
| C093 | 475 | MSRKMFSCDFETTTKLDDCRVWAYGYMEIGNLDNYKIGNSLDEFMQWVMEIQADLYFHNLK
FDGAFIINWLERNGFKWSADGLPNTYNTIISRMGQWYMIDICLGYKGKRKIHTVIYDSLKK
LPFPVEKIAKDFKLTVKKGDIDIHKERPVGYKITPEEYAYIKNDIQIIAEALLIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYQGEYKENIQYPLYIQNIKVRFRLKERHIPTIQVKQNS
LFIQNEYLENSVNKLGVDELIELTLTNVDLDLFFEHYEILEIHYTYGYMFRGSCDMFKDFI
DKWTYIKTTSYGAIKQLAKLMLNSLYGKFASNPDVTGKVPYLKENGALGFRLGEEETKDPV
YTPMGVFITAWGRYTTITAAQACYDRIIYCDTDSIHLTGTEIPDVIKDIVDPKKLGYWEHE
STFKRAKYLRQKTYIQDIYMKRVKGYLVQGSPDDYTDIKFSVKCAGMTDKIKKEVTFENFK
VGFSRKMKPKPVQVPGGVVLVDETFTIK |
| C094 | 476 | MSRKMFSCDFETTTKLDDCRVWAYGYMEIGNLDNYKIGNSLDEFMQWVMEIQADLYFHNLK
FDGAFIINWLERNGFKWSADGLPNTYNTIISRMGQWYMIDICLGYKGKRKIHTVIYDSLKK |

TABLE 4-continued

Chimeric Polymerase Variants

| Name | SEQ ID NO | Sequence |
|---|---|---|
| | | LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEMV<br>FDANSHYPAQMYVRPLPYGTPLFYEGEYKENIDHPLYIQNLKVRFRLKERHIPCIQVKQSS<br>LFIQTEYLESSVNKLGVDELIELTLTNVDLDLFFEHYEILEIHFTYGYMFRGSCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C095 | 477 | MSRKMFSCDFETTTKLDDCRVWAYGYMEIGNLDNYKIGNSLDEFMQWVMEIQADLYFHNLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQYPLYIQNIKVRFRLKERHIPTIQVKQNS<br>LFIQTEYLENSVNKLGVDELIDLTVTNVDLDLFFEHYDILEIHFTYGYMFKASCDMFKDFI<br>DKFTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C096 | 478 | MSRKMFSCDFETTTKLDDCRVWAYGYMEIGNLDNYKIGNSLDEFMQWVMEIQADLYFHNLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQTEYLESSVNKLGVDELIDLTVTNVDLDLFFEHYDILEIHFTYGYMFKASCDMFKDFI<br>DKFTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C097 | 479 | MSRKMFSCDFETTTKLDDCRVWAYGYMEIGNLDNYKIGNSLDEFMQWVMEIQADLYFHNLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQHPLYIQNLKVRFRLKERHIPCIQVKQSS<br>LFIQTEYLENSVNKLGVDELIELTVTNVDLDLFFEHYEILEIHFTYGYMFRGSCDMFKDFI<br>DKFTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C098 | 480 | MSRKMFSCDFETTTKLDDCRVWAYGYMEIGNLDNYKIGNSLDEFMQWVMEIQADLYFHNLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIQYPLYIQNLKVRFRLKERHIPTIQVKQNS<br>LFIQTEYLENSVNKLGVDELIELTVTNVDLDLFFEHYEILEIHFTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C099 | 481 | MSRKMFSCDFETTTKLDDCRVWAYGYMEIGNLDNYKIGNSLDEFMQWVMEIQADLYFHDLK<br>FDGAFIVNWLEKNGFKWSAEGLPNTYNTIISRMGQWYMIDICFGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0100 | 482 | MSRKMFSCDFETTTKLDDCRVWAYGYMEIGNLDNYKIGNSLDEFMQWVMEIQADLYFHDLK<br>FDGAFIVNWLEKNGFKWSAEGLPNTYNTIISRMGQWYMIDICIGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNLKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |

TABLE 4-continued

Chimeric Polymerase Variants

| Name | SEQ ID NO | Sequence |
|---|---|---|
| C0101 | 483 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKLHTIIYDSLKK<br>LPFPVEKIAKDFKLTLKKGDIDIHKERPIGYKITPDEYAYLKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0102 | 484 | MSRKMFSCDFETTTKLDDCRVWAYGYMEIGNLDNYKIGNSLDEFMQWVMEIQADLYFHDLK<br>FDGAFIVNWLEKNGFKWSAEGLPNTYNTIISRMGQWYMIDICFGYKGKRKLHTIIYDSLKK<br>LPFPVEKIAKDFKLTLKKGDIDIHKERPIGYKITPDEYAYLKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0103 | 485 | MSRKMFSCDFETTTKLDDCRVWAYGYMEIGNLDNYKIGNSLDEFMQWVMEIQADLYFHDLK<br>FDGAFIVNWLEKNGFKWSAEGIPNTYNTIISRMGQWYMIDICFGYKGKRKLHTIIYDSLKK<br>LPFPVEKIAKDFKLTLKKGDIDIHKERPIGYKITPDEYAYLKNDIQILAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0104 | 486 | MSRKMFSCDFETTTKLDDCRVWAYGYMEIGNLDNYKIGNSLDEFMQWVMEIQADLYFHDLK<br>FDGAFIINWLEQHGFKWSNEGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0105 | 487 | MSRKMFSCDFETTTKLDDCRVWAYGYMEIGNLDNYKIGNSLDEFMQWVMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C0106 | 488 | MSRKMFSCDFETTTKLDDCRVWAYGYMEIGNLDNYKIGNSLDEFMQWVMEIQADLYFHDLK<br>FDGAFIINWLLHNGYTWTKRPSKEGQFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C0107 | 489 | MSRKMFSCDFETTTKLDDCRVWAYGYMEIGNLDNYKIGNSLDEFMQWVMEIQADLYFHDLK<br>FDGAFIINWLLHKGYECNESGRPKTFDTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV |

TABLE 4-continued

Chimeric Polymerase Variants

| Name | SEQ ID NO | Sequence |
|---|---|---|
| | | YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0108 | 490 | MSRKMFSCDFETTTKLDDCRVWAYGYMEIGNLDNYKIGNSLDEFMQWVMEIQADLYFHDLK<br>FDGAFIINWLLKHGYRWTKENPGVKEFTTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMPKASCDMFKDF<br>IDKWTYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C0109 | 491 | MSRKMFSCDFETTTKLDDCRVWAYGYMEIGNLDNYKIGNSLDEFMQWVMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMPKASCDMFKDF<br>IDKWTYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C0110 | 492 | MSRKMFSCDFETTTKLDDCRVWAYGYMEIGNLDNYKIGNSLDEFMQWVMEIQADLYFHDLK<br>FDGAFIINWLEKNGFKWTAEGEPNTYSTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMPKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0111 | 493 | MSRKMFSCDFETTTKLDDCRVWAYGYMEIGNLDNYKIGNSLDEFMQWVMEIQADLYFHDLK<br>FDGAFIINWLLKNGFKWTAEGLPRTYSTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMPKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0112 | 494 | MSRKMFSCDFETTTKLDDCRVWAYGYMEIGNLDNYKIGNSLDEFMQWVMEIQADLYFHDLK<br>FDGAFIINWLFKNGYKWTAEGLPNTFSTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMPKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0113 | 495 | MSRKMFSCDFETTTKLDDCRVWAYGYMEIGNLDNYKIGNSLDEFMQWVMEIQADLYFHDLK<br>FDGAFIINWLEKNGYKWTAEGLPKTFSTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMPKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0114 | 496 | MSRKMFSCDFETTTKLDDCRVWAYGYMEIGNLDNYKIGNSLDEFMQWVMEIQADLYFHDLK<br>FDGAFIINWLLRNGYVHTEEDRTNTPKEFTTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE |

TABLE 4-continued

Chimeric Polymerase Variants

| Name | SEQ ID NO | Sequence |
|---|---|---|
| | | GMVFDANSHYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C0115 | 497 | MSRKMFSCDFETTTKLDDCRVWAYGYMEIGNLDNYKIGNSLDEFMQWVMEIQADLYFHDLK<br>FDGAFIINWLFRLGYEFTDEKAPQVKEFSTIISRMGQWYMIDICLGYKGKRKIHTVIYDSL<br>KKLPFPVEKIAKDFKLTVKKGDIDIHKERPVGYKITPEEYAYIKNDIQIIAEALLIQFKQG<br>LDRMTAGSDSLKGFKDIITTKKFKKVFPTLSLGLDKEVRKAYRGGFTWLNDRFKGKEIGEG<br>MVFDANSHYPAQMYVRPLPYGTPLFYEGEYKENIDYPLYIQNIKVRFRLKERHIPTIQVKQ<br>SSLFIQNEYLESSVNKLGVDELIDLTLTNVDLDLFFEHYDILEIHYTYGYMFKASCDMFKD<br>FIDKWTYIKTTSYGAIKQLAKLMLNSLYGKFASNPDVTGKVPYLKENGALGFRLGEEETKD<br>PVYTPMGVFITAWGRYTTITAAQACYDRIIYCDTDSIHLTGTEIPDVIKDIVDPKKLGYWE<br>HESTFKRAKYLRQKTYIQDIYMKRVKGYLVQGSPDDYTDIKFSVKCAGMTDKIKKEVTFEN<br>FKVGFSRKMKPKPVQVPGGVVLVDETFTIK |
| C0116 | 498 | MSRKMFSCDFETTTKLDDCRVWAYGYMEIGNLDNYKIGNSLDEFMQWVMEIQADLYFHDLK<br>FDGAFIINWLLTDGWKWIPDKNDCANRTFTTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C0117 | 499 | MSRKMFSCDFETTTKLDDCRVWAYGYMEIGNLDNYKIGNSLDEFMQWVMEIQADLYFHDLK<br>FDGAFIINWLLENGFKHSRERALYSNEFSTIISRMGQWYMIDICLGYKGKRKIHTVIYDSL<br>KKLPFPVEKIAKDFKLTVKKGDIDIHKERPVGYKITPEEYAYIKNDIQIIAEALLIQFKQG<br>LDRMTAGSDSLKGFKDIITTKKFKKVFPTLSLGLDKEVRKAYRGGFTWLNDRFKGKEIGEG<br>MVFDANSHYPAQMYVRPLPYGTPLFYEGEYKENIDYPLYIQNIKVRFRLKERHIPTIQVKQ<br>SSLFIQNEYLESSVNKLGVDELIDLTLTNVDLDLFFEHYDILEIHYTYGYMFKASCDMFKD<br>FIDKWTYIKTTSYGAIKQLAKLMLNSLYGKFASNPDVTGKVPYLKENGALGFRLGEEETKD<br>PVYTPMGVFITAWGRYTTITAAQACYDRIIYCDTDSIHLTGTEIPDVIKDIVDPKKLGYWE<br>HESTFKRAKYLRQKTYIQDIYMKRVKGYLVQGSPDDYTDIKFSVKCAGMTDKIKKEVTFEN<br>FKVGFSRKMKPKPVQVPGGVVLVDETFTIK |
| C0118 | 500 | MSRKMFSCDFETTTKLDDCRVWAYGYMEIGNLDNYKIGNSLDEFMQWVMEIQADLYFHDLK<br>FDGAFIINWLLGVAKWEYNDKPKARKAKTVETIISRMGQWYMIDICLGYKGKRKIHTVIYD<br>SLKKLPFPVEKIAKDFKLTVKKGDIDIHKERPVGYKITPEEYAYIKNDIQIIAEALLIQFK<br>QGLDRMTAGSDSLKGFKDIITTKKFKKVFPTLSLGLDKEVRKAYRGGFTWLNDRFKGKEIG<br>EGMVFDANSHYPAQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMF<br>KDFIDKWTYIKTTSYGAIKQLAKLMLNSLYGKFASNPDVTGKVPYLKENGALGFRLGEEET<br>KDPVYTPMGVFITAWGRYTTITAAQACYDRIIYCDTDSIHLTGTEIPDVIKDIVDPKKLGY<br>WEHESTFKRAKYLRQKTYIQDIYMKRVKGYLVQGSPDDYTDIKFSVKCAGMTDKIKKEVTF<br>ENFKVGFSRKMKPKPVQVPGGVVLVDETFTIK |
| C0119 | 501 | MSRKMYSADFETTTKLDDCRVWSYGWMEVGNLDNYKIGNDIDEFMQWVMEIQSDLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0120 | 502 | MSRKMYSCDFETTTKLDDCRVWAYGVMEVGNLDNYKIGNDIDEFMQWIMEIQSDLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI |

TABLE 4-continued

Chimeric Polymerase Variants

| Name | SEQ ID NO | Sequence |
|---|---|---|

```
            DKWTYIKTTSYGAIKQLAKLMLNSLYGKFASNPDVTGKVPYLKENGALGFRLGEEETKDPV
            YTPMGVFITAWGRYTTITAAQACYDRIIYCDTDSIHLTGTEIPDVIKDIVDPKKLGYWEHE
            STFKRAKYLRQKTYIQDIYMKRVKGYLVQGSPDDYTDIKFSVKCAGMTDKIKKEVTFENFK
            VGFSRKMKPKPVQVPGGVVLVDETFTIK

C01215 503 MSRKVFTADFETTTKLDDCRVWAYGWMEVGNLDNYKIGNSIDEFMQWVMEIQADLYFHDLK
            FDGAFIINWLERNGFKWSADGLPNTYNTIISRMGQWYMIDICLGYKGKRKIHTVIYDSLKK
            LPFPVEKIAKDFKLTVKKGDIDIHKERPVGYKITPEEYAYIKNDIQIIAEALLIQFKQGLD
            RMTAGSDSLKGFKDIITTKKFKKVFPTLSLGLDKEVRKAYRGGFTWLNDRFKGKEIGEGMV
            FDANSHYPAQMYVRPLPYGTPLFYEGEYKENIDYPLYIQNIKVRFRLKERHIPTIQVKQSS
            LFIQNEYLESSVNKLGVDELIDLTLTNVDLDLFFEHYDILEIHYTYGYMFKASCDMFKDFI
            DKWTYIKTTSYGAIKQLAKLMLNSLYGKFASNPDVTGKVPYLKENGALGFRLGEEETKDPV
            YTPMGVFITAWGRYTTITAAQACYDRIIYCDTDSIHLTGTEIPDVIKDIVDPKKLGYWEHE
            STFKRAKYLRQKTYIQDIYMKRVKGYLVQGSPDDYTDIKFSVKCAGMTDKIKKEVTFENFK
            VGFSRKMKPKPVQVPGGVVLVDETFTIK

C01225 504 MSRKVYTADFETTTKLDDCRVWAYGWMEVGNLDNYKIGNSIDEFMQWIMEIQADLYFHDLK
            FDGAFIINWLERNGFKWSADGLPNTYNTIISRMGQWYMIDICLGYKGKRKIHTVIYDSLKK
            LPFPVEKIAKDFKLTVKKGDIDIHKERPVGYKITPEEYAYIKNDIQIIAEALLIQFKQGLD
            RMTAGSDSLKGFKDIITTKKFKKVFPTLSLGLDKEVRKAYRGGFTWLNDRFKGKEIGEGMV
            FDANSHYPAQMYVRPLPYGTPLFYEGEYKENIDYPLYIQNIKVRFRLKERHIPTIQVKQSS
            LFIQNEYLESSVNKLGVDELIDLTLTNVDLDLFFEHYDILEIHYTYGYMFKASCDMFKDFI
            DKWTYIKTTSYGAIKQLAKLMLNSLYGKFASNPDVTGKVPYLKENGALGFRLGEEETKDPV
            YTPMGVFITAWGRYTTITAAQACYDRIIYCDTDSIHLTGTEIPDVIKDIVDPKKLGYWEHE
            STFKRAKYLRQKTYIQDIYMKRVKGYLVQGSPDDYTDIKFSVKCAGMTDKIKKEVTFENFK
            VGFSRKMKPKPVQVPGGVVLVDETFTIK

C01235 505 MSRKMYTADFETTTKLDDCRVWAYGYMEVGNLDNYKIGNDIDEFMQWIMEIQADLYFHDLK
            FDGAFIINWLERNGFKWSADGLPNTYNTIISRMGQWYMIDICLGYKGKRKIHTVIYDSLKK
            LPFPVEKIAKDFKLTVKKGDIDIHKERPVGYKITPEEYAYIKNDIQIIAEALLIQFKQGLD
            RMTAGSDSLKGFKDIITTKKFKKVFPTLSLGLDKEVRKAYRGGFTWLNDRFKGKEIGEGMV
            FDANSHYPAQMYVRPLPYGTPLFYEGEYKENIDYPLYIQNIKVRFRLKERHIPTIQVKQSS
            LFIQNEYLESSVNKLGVDELIDLTLTNVDLDLFFEHYDILEIHYTYGYMFKASCDMFKDFI
            DKWTYIKTTSYGAIKQLAKLMLNSLYGKFASNPDVTGKVPYLKENGALGFRLGEEETKDPV
            YTPMGVFITAWGRYTTITAAQACYDRIIYCDTDSIHLTGTEIPDVIKDIVDPKKLGYWEHE
            STFKRAKYLRQKTYIQDIYMKRVKGYLVQGSPDDYTDIKFSVKCAGMTDKIKKEVTFENFK
            VGFSRKMKPKPVQVPGGVVLVDETFTIK

C01245 506 MSRKMYSADFETTTKLDDCRVWAYGYMEVGNLDNYKIGNSIDEFMQWIMEIQSDLYFHDLK
            FDGAFIINWLERNGFKWSADGLPNTYNTIISRMGQWYMIDICLGYKGKRKIHTVIYDSLKK
            LPFPVEKIAKDFKLTVKKGDIDIHKERPVGYKITPEEYAYIKNDIQIIAEALLIQFKQGLD
            RMTAGSDSLKGFKDIITTKKFKKVFPTLSLGLDKEVRKAYRGGFTWLNDRFKGKEIGEGMV
            FDANSHYPAQMYVRPLPYGTPLFYEGEYKENIDYPLYIQNIKVRFRLKERHIPTIQVKQSS
            LFIQNEYLESSVNKLGVDELIDLTLTNVDLDLFFEHYDILEIHYTYGYMFKASCDMFKDFI
            DKWTYIKTTSYGAIKQLAKLMLNSLYGKFASNPDVTGKVPYLKENGALGFRLGEEETKDPV
            YTPMGVFITAWGRYTTITAAQACYDRIIYCDTDSIHLTGTEIPDVIKDIVDPKKLGYWEHE
            STFKRAKYLRQKTYIQDIYMKRVKGYLVQGSPDDYTDIKFSVKCAGMTDKIKKEVTFENFK
            VGFSRKMKPKPVQVPGGVVLVDETFTIK

C01255 507 MKHMPRKMYSCDFETTTKVEDCRVWAYGYMNIEDHSEYKIGNSLDEFMAWVLKVQADLYFH
            NLKFDGAFIINWLERNGFKWSADGLPNTYNTIISRMGQWYMIDICLGYKGKRKIHTVIYDS
            LKKLPFPVKKIAKDFKLTVKKGDIDIHKERPVGYKITPEEYAYIKNDIQIIAEALLIQFKQ
            GLDRMTAGSDSLKGFKDIITTKKFKKVFPTLSLGLDKEVRKAYRGGFTWLNDRFKGKEIGE
            GMVFDANSHYPAQMYVRPLPYGTPLFYEGEYKENIDYPLYIQNIKVRFRLKERHIPTIQVK
            QSSLFIQNEYLESSVNKLGVDELIDLTLTNVDLDLFFEHYDILEIHYTYGYMFKASCDMFK
            DFIDKWFYIKTTSEGAIKQLAKLMLNSLYGKFASNPDVTGKVPYLKENGALGFRLGEEETK
            DPVYTPMGVFITAWGRYTTITAAQACYDRIIYCDTDSIHLTGTEIPDVIKDIVDPKKLGYW
            AHESTFKRAKYLRQKTYIQDIYMKRVKGYLVQGSPDDYTDIKFSVKCAGMTDKIKKEVTFE
            NFKVGFSRKMKPKPVQVPGGVVLVDETFTIK

C01265 508 MKHMPRKMYSCDFETTTKVEDCRVWAYGYMNIEDHSEYKIGNSLDEFMAWVLKVQADLYFH
            NLKFDGAFIINWLERNGFKWSADGLPNTYNTIISRMGQWYMIDICLGYKGKRKIHTVIYDS
            LKKLPFPVKKIAKDFKLTVKKGDIDIHKERPVGYKITPEEYAYIKNDIQIIAEALLIQFKQ
            GLDRMTAGSDSLKGFKDIITTKKFKKVFPTLSLGLDKEVRKAYRGGFTWLNDRFKGKEIGE
            GMVFDANSHYPAQMYVRPLPYGTPLFYEGEYKENIDYPLYIQNIKVRFRLKERHIPTIQVK
            QSSLFIQNEYLESSVNKLGVDELIDLTLTNVDLDLFFEHYDILEIHYTYGYMFKASCDMFK
            DFIDKWFYIKTTSEGAIKQLAKLMLNSLYGKFASNPDVTGKVPYLKENGALGFRLGEEETK
            DPVYTPMGVFITAWGRYTTITAAQACYDRIIYCDTDSIHLTGTEIPDVIKDIVDPKKLGYW
            NHESTFKRAKYLRQKTYIQDIYMKRVKGYLVQGSPDDYTDIKFSVKCAGMTDKIKKEVTFE
            NFKVGFSRKMKPKPVQVPGGVVLVDETFTIK

C01275 509 MKHMPRKMYSCDFETTTKVEDCRVWAYGYMNIEDHSEYKIGNSLDEFMAWVLKVQADLYFH
            NLKFDGAFIINWLERNGFKWSADGLPNTYNTIISRMGQWYMIDICLGYKGKRKIHTVIYDS
            LKKLPFPVKKIAKDFKLTVKKGDIDIHKERPVGYKITPEEYAYIKNDIQIIAEALLIQFKQ
```

TABLE 4-continued

Chimeric Polymerase Variants

| Name | SEQ ID NO | Sequence |
|---|---|---|
| | | GLDRMTAGSDSLKGFKDIITTKKFKKVFPTLSLGLDKEVRKAYRGGFTWLNDRFKGKEIGE<br>GMVFDANSHYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWFYIKTTSEGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>QHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C01285 | 10 | MKHMPRKMYSCDFETTTKVEDCRVWAYGYMNIEDHSEYKIGNSLDEFMAWVLKVQADLYFH<br>NLKFDGAFIINWLERNGFKWSADGLPNTYNTIISRMGQWYMIDICLGYKGKRKIHTVIYDS<br>LKKLPFPVKKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWFYIKTRSEGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>AHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C01295 | 11 | MSRKRFSCDFETTTKLDDCRVWAYGYMEIGNLDNYKIGNSLDEFMQWAMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01305 | 12 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTKIPDVIKDIVHPKKLGYWEHE<br>STFKRAKYLRQKTYIQDIYMKRVKGYLVQGSPDDYTDIKFSVKCAGMTDKIKEEVTFENFK<br>VGFSRKMKPKPVQVPGGVVLVDSVFTIK |
| C01315 | 13 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRFTTITAAQACYDRIIYCDTDSIHLTGTKIPDVIKDIVHPKKLGYWEHE<br>STFKRAKYLRQKTYIQDIYMKRVKGYLVQGSPDDYTDIKFSVKCAGMTDKIKEEVTFDNFK<br>VGFSRKMKPKPVQVPGGVVLVDSVFTIK |
| C01325 | 14 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01335 | 15 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIQYPLYIQNIKVRFRLKERHIPTIQVKQSS<br>LFIQNEYLESSVNKLGVDELIDLTLTNVDLDLFFEHYDILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRFTTITAAQACYDRIIYCDTDSIHLTGTKIPDVIKDIVHPKKLGYWEHE<br>STFKRAKYLRQKTYIQDIYMKRVKGYLVQGSPDDYTDIKFSVKCAGMTDKIKEEVTFDNFK<br>VGFSRKMKPKPVQVPGGVVLVDSVFTIK |

TABLE 4-continued

Chimeric Polymerase Variants

| Name | SEQ ID NO | Sequence |
|---|---|---|
| C01345 | 16 | MSRKMFSCDFETTTKLDDCRVWAYGYMEIGNLDNYKIGNSLDEFMQWVMEIQADLYFHDLK FDGAFIINWLERNGFKWSADGLPNTYNTIISRMGQWYMIDICLGYKGKRKIHTVIYDSLKK LPFPVEKIAQDFKLTVKKGDIDIHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMV FDINSHYPAQMYVRPLPYGTPLFYEGEYKENIQYPLYIQNIKVRFRLKERHIPTIQVKQSS LFIQNEYLESSVNKLGVDELIDLTLTNVDLDLFFEHYDILEIHYTYGYMFRASCDMFKDFI DKWTYIKTTSYGAIKQLAKLMLNSLYGKFASNPDVTGKVPYLKENGALGFRLGEEETKDPV YTPMGVFITAWGRFTTITAAQACYDRIIYCDTDSIHLTGTKIPDVIKDIVHPKKLGYWEHE STFKRAKYLRQKTYIQDIYMKRVKGYLVQGSPDDYTDIKFSVKCAGMTDKIKEEVTFDNFK VGFSRKMKPKPVQVPGGVVLVDSVFTIK |
| C01355 | 17 | MSRKRFSCDFETTTKLDDCRVWAYGYMEIGNLDNYKIGNSLDEFMQWAMEIQADLYFHDLK FDGAFIINWLERNGFKWSADGLPNTYNTIISRMGQWYMIDICLGYKGKRKIHTVIYDSLKK LPFPVEKIAKDFKLTVKKGDIDIHKERPVGYKITPEEYAYIKNDIQIIAEALLIQFKQGLD RMTAGSDSLKDFKDIITTKKFKKVFPTLSLGLDKEVRKAYRGGFTWLNDRFKGKEIGEGMV FDANSHYPAQMYVRPLPYGTPLFYEGEYKENIDYPLYIQNIKVRFRLKERHIPTIQVKQSS LFIQNEYLESSVNKLGVDELIDLTLTNVDLDLFFEHYDILEIHYTYGYMFKASCDMFKDFI DKWTYIKTTSYGAIKQLAKLMLNSLYGKFASNPDVTGKVPYLKENGALGFRLGEEETKDPV YTPMGVFITAWGRYTTITAAQACYDRIIYCDTDSIHLTGTKIPDVIKDIVHPKKLGYWEHE STFKRAKYLRQKTYIQDIYMKRVKGYLVQGSPDDYTDIKFSVKCAGMTDKIKEEVTFENFK VGFSRKMKPKPVQVPGGVVLVDSVFTIK |
| C01365 | 18 | MSRKRFSCDFETTTKLDDCRVWAYGYMEIGNLDNYKIGNSLDEFMQWAMEIQADLYFHDLK FDGAFIINWLERNGFKWSADGLPNTYNTIISRMGQWYMIDICLGYKGKRKIHTVIYDSLKK LPFPVEKIAKDFKLTVKKGDIDIHKERPVGYKITPEEYAYIKNDIQIIAEALLIQFKQGLD RMTAGSDSLKDFKDIITTKKFKKVFPTLSLGLDKEVRKAYRGGFTWLNDRFKGKEIGEGMV FDANSHYPAQMYVRPLPYGTPLFYEGEYKENIQYPLYIQNIKVRFRLKERHIPTIQVKQSS LFIQNEYLESSVNKLGVDELIDLTLTNVDLDLFFEHYDILEIHYTYGYMFRASCDMFKDFI DKWTYIKTTSYGAIKQLAKLMLNSLYGKFASNPDVTGKVPYLKENGALGFRLGEEETKDPV YTPMGVFITAWGRFTTITAAQACYDRIIYCDTDSIHLTGTKIPDVIKDIVHPKKLGYWEHE STFKRAKYLRQKTYIQDIYMKRVKGYLVQGSPDDYTDIKFSVKCAGMTDKIKEEVTFDNFK VGFSRKMKPKPVQVPGGVVLVDSVFTIK |
| C01375 | 19 | MSRKRFSCDFETTTKLDDCRVWAYGYMEIGNLDNYKIGNSLDEFMQWAMEIQADLYFHDLK FDGAFIINWLERNGFKWSADGLPNTYNTIISRMGQWYMIDICLGYKGKRKIHTVIYDSLKK LPFPVEKIAQDFKLTVKKGDIDIHKERPVGYKITPEEYAYIKNDIQIIAEALLIQFKQGLD RMTAGSDSLKDFKDIITTKKFKKVFPTLSLGLDKEVRKAYRGGFTWLNDRFKGKEIGEGMV FDINSHYPAQMYVRPLPYGTPLFYEGEYKENIQYPLYIQNIKVRFRLKERHIPTIQVKQSS LFIQNEYLESSVNKLGVDELIDLTLTNVDLDLFFEHYDILEIHYTYGYMFRASCDMFKDFI DKWTYIKTTSYGAIKQLAKLMLNSLYGKFASNPDVTGKVPYLKENGALGFRLGEEETKDPV YTPMGVFITAWGRFTTITAAQACYDRIIYCDTDSIHLTGTKIPDVIKDIVHPKKLGYWEHE STFKRAKYLRQKTYIQDIYMKRVKGYLVQGSPDDYTDIKFSVKCAGMTDKIKEEVTFDNFK VGFSRKMKPKPVQVPGGVVLVDSVFTIK |
| C01385 | 20 | MSRKRFSCDFETTTKLDDCRVWAYGYMEIGNLDNYKIGNSLDEFMQWAMEIQADLYFHDLK FDGAFIINWLERNGFKWSADGLPNTYNTIISRMGQWYMIDICLGYKGKRKIHTVIYDSLKK LPFPVEKIAKDFKLTVKKGDIDIHKERPVGYKITPEEYAYIKNDIQIIAEALLIQFKQGLD RMTAGSDSLKDFKDIITTKKFKKVFPTLSLGLDKEVRKAYRGGFTWLNDRFKGKEIGEGMV FDANSHYPAQMYVRPLPYGTPLFYEGEYKENIDHPLYIQNLKVRFRLKERHIPCIQVKQSS LFIQNEYLESSVNKLGVDELIELTLTNVDLDLFFEHYEILEIHYTYGYMFRASCDMFKDFI DKWTYIKTTSYGAIKQLAKLMLNSLYGKFASNPDVTGKVPYLKENGALGFRLGEEETKDPV YTPLASFVTAWGRYTTITTAQACYDRIIYCDTDSIHLTGTEIPDVIKDIVDPKKLGYWEHE STFKRAKYLRQKTYIQDIYMKRVKGYLVQGSPDDYTDIKFSVKCAGMTDKIKKEVTFENFK VGFSRKMKPKPVQVPGGVVLVDETFTIK |
| C01395 | 21 | MSRKMFSCDFETTTKLDDCRVWAYGYMEIGNLDNYKIGNSLDEFMQWVMEIQADLYFHDLK FDGAFIINWLERNGFKWSADGLPNTYNTIISRMGQWYMIDICLGYKGKRKIHTVIYDSLKK LPFPVEKIAKDFKLTVKKGDIDIHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMV FDANSHYPAQMYVRPLPYGTPLFYEGEYKENIDHPLYIQNLKVRFRLKERHIPCIQVKQSS LFIQNEYLESSVNKLGVDELIELTLTNVDLDLFFEHYEILEIHYTYGYMFRASCDMFKDFI DKWTYIKTTSYGAIKQLAKLMLNSLYGKFASNPDVTGKVPYLKENGALGFRLGEEETKDPV YTPLASFVTAWGRYTTITTAQACYDRIIYCDTDSIHLTGTKIPDVIKDIVHPKKLGYWEHE STFKRAKYLRQKTYIQDIYMKRVKGYLVQGSPDDYTDIKFSVKCAGMTDKIKEEVTFENFK VGFSRKMKPKPVQVPGGVVLVDSVFTIK |
| C01405 | 22 | MSRKRFSCDFETTTKLDDCRVWAYGYMEIGNLDNYKIGNSLDEFMQWAMEIQADLYFHDLK FDGAFIINWLERNGFKWSADGLPNTYNTIISRMGQWYMIDICLGYKGKRKIHTVIYDSLKK LPFPVEKIAKDFKLTVKKGDIDIHKERPVGYKITPEEYAYIKNDIQIIAEALLIQFKQGLD RMTAGSDSLKDFKDIITTKKFKKVFPTLSLGLDKEVRKAYRGGFTWLNDRFKGKEIGEGMV FDANSHYPAQMYVRPLPYGTPLFYEGEYKENIDHPLYIQNLKVRFRLKERHIPCIQVKQSS LFIQNEYLESSVNKLGVDELIELTLTNVDLDLFFEHYEILEIHYTYGYMFRASCDMFKDFI DKWTYIKTTSYGAIKQLAKLMLNSLYGKFASNPDVTGKVPYLKENGALGFRLGEEETKDPV YTPLASFVTAWGRYTTITTAQACYDRIIYCDTDSIHLTGTKIPDVIKDIVHPKKLGYWEHE |

TABLE 4-continued

Chimeric Polymerase Variants

| Name | SEQ ID NO | Sequence |
|---|---|---|
| | | STFKRAKYLRQKTYIQDIYMKRVKGYLVQGSPDDYTDIKFSVKCAGMTDKIKEEVTFENFK<br>VGFSRKMKPKPVQVPGGVVLVDSVFTIK |
| C01415 | 23 | MSRKMFSCDFETTTKLDDCRVWAYGYMEIGNLDNYKIGNSLDEFMQWVMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C01425 | 24 | MSRKMFSCDFETTTKLDDCRVWAYGYMEIGNLDNYKIGNSLDEFMQWVMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C01435 | 25 | MSRKRFSCDFETTTKLDDCRVWAYGYMEIGNLDNYKIGNSLDEFMQWAMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDANSHYPAQMYVRPLPYGTPLFYEGEYKENIQHPLYIQNLKVRFRLKERHIPCIQVKQSS<br>LFIQNEYLESSVNKLGVDELIELTLTNVDLDLFFEHYEILEIHYTGYMFRASCDMFKDFI<br>DKWTYIKTTSYGAIKQLAKLMLNSLYGKFASNPDVTGKVPYLKENGALGFRLGEEETKDPV<br>YTPLASFVTAWGRFTTITTAQACYDRIIYCDTDSIHLTGTKIPDVIKDIVHPKKLGYWEHE<br>STFKRAKYLRQKTYIQDIYMKRVKGYLVQGSPDDYTDIKFSVKCAGMTDKIKEEVTFDNFK<br>VGFSRKMKPKPVQVPGGVVLVDSVFTIK |
| C01445 | 26 | MSRKMFSCDFETTTKLDDCRVWAYGYMEIGNLDNYKIGNSLDEFMQWVMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C01455 | 27 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C01465 | 28 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIQHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGALGFRLGEEETKDP<br>VYTPLASFVTAWGRFTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFDNF<br>KVGFSRKMKPKPVQVPGGVVLVDSVFTIK |
| C01475 | 29 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAQDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSHYPAQMYVRPLPYGTPLFYEGEYKENIQHPLYIQNLKVRFRLKERHIPCIQVKQS |

TABLE 4-continued

Chimeric Polymerase Variants

| Name | SEQ ID NO | Sequence |
|---|---|---|
| | | SLFIQNEYLESSVNKLGVDELIELTLTNVDLDLFFEHYEILEIHYTYGYMFRASCDMFKDF
IDKWTYIKTTSYGAIKQLAKLMLNSLYGKFASNPDVTGKVPYLKENGALGFRLGEEETKDP
VYTPLASFVTAWGRFTTITTAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFDNF
KVGFSRKMKPKPVQVPGGVVLVDSVFTIK |
| C0148 | 530 | MSRKRFSCDFETTTKLDDCRVWAYGYMEIGNLDNYKIGNSLDEFMQWAMEIQADLYFHDLK
FDGAFIINWLFKNGFKWCKEAKEERTFSTIISRMGQWYMIDICLGYKGKRKIHTVIYDSLK
KLPFPVEKIAQDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSHYPAQMYVRPLPYGTPLFYQGEYKENIQHPLYIQNLKVRFRLKERHIPCIQVKQN
SLFIQNEYLENSVNKLGVDELIELTLTNVDLDLFFEHYEILEIHYTYGYMFRASCDMFKDF
IDKWTYIKTTSYGAIKQLAKLMLNSLYGKFASNPDVTGKVPYLKENGALGFRLGEEETKDP
VYTPLASFVTAWGRFTTITTAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFDNF
KVGFSRKMKPKPVQVPGGVVLVDSVFTIK |
| C0149 | 531 | MSRKRFSCDFETTTKLDDCRVWAYGYMEIGNLDNYKIGNSLDEFMQWAMEIQADLYFHDLK
FDGAFIINWLFKNGFKWCKEAKEERTFSTIISRMGQWYMIDICLGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDANSHYPAQMYVRPLPYGTPLFYQGEYKENIQHPLYIQNLKVRFRLKERHIPCIQVKQN
SLFIQNEYLENSVNKLGVDELIELTLTNVDLDLFFEHYEILEIHYTYGYMFRASCDMFKDF
IDKWTYIKTTSYGAIKQLAKLMLNSLYGKFASNPDVTGKVPYLKENGALGFRLGEEETKDP
VYTPLASFVTAWGRFTTITTAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFDNF
KVGFSRKMKPKPVQVPGGVVLVDSVFTIK |
| C0150 | 532 | MSRKRFSCDFETTTKLDDCRVWAYGYMEVGNLDNYKIGNSIDEFMQWAMEIQADLYFHDLK
FDGAFIINWLFKNGFKWCKEAKEERTFSTIISRMGQWYMIDICLGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDANSHYPAQMYVRPLPYGTPLFYQGEYKENIQHPLYIQNLKVRFRLKERHIPCIQVKQN
SLFIQNEYLENSVNKLGVDELIELTLTNVDLDLFFEHYEILEIHYTYGYMFRASCDMFKDF
IDKWTYIKTTSYGAIKQLAKLMLNSLYGKFASNPDVTGKVPYLKENGALGFRLGEEETKDP
VYTPLASFVTAWGRFTTITTAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFDNF
KVGFSRKMKPKPVQVPGGVVLVDSVFTIK |
| C0151 | 533 | MHKMSKKMFSCDFETTTKLDDCRVWAYGYMEVGNLDNYKIGNNIDEFMQWIMEIQADLYFH
DLKFDGAFIINWLERNGFKWSADGLPNTYNTIISRMGQWYMIDICLGYKGKRKIHTVIYDS
LKKLPFPVEKIAKDFKLTVKKGDIDIHKERPVGYKITPEEYAYIKNDIQIIAEALLIQFKQ
GLDRMTAGSDSLKGFKDIITTKKFKKVFPTLSLGLDKEVRKAYRGGFTWLNDRFKGKEIGE
GMVFDANSHYPAQMYVRPLPYGTPLFYEGEYKENIDYPLYIQNIKVRFRLKERHIPTIQVK
QSSLFIQNEYLESSVNKLGVDELIDLTLTNVDLDLFFEHYDILEIHYTYGYMFKASCDMFK
DFIDKWTYIKTTSYGAIKQLAKLMLNSLYGKFASNPDVTGKVPYLKENGALGFRLGEEETK
DPVYTPMGVFITAWGRYTTITAAQACYDRIIYCDTDSIHLTGTEIPDVIKDIVDPKKLGYW
EHESTFKRAKYLRQKTYIQDIYMKRVKGYLVQGSPDDYTDIKFSVKCAGMTDKIKKEVTFE
NFKVGFSRKMKPKPVQVPGGVVLVDETFTIK |
| C0152 | 534 | MHKMSRKMFSCDFETTTKLDDCRVWAYGYMEVGNLDNYKIGNSIDEFMQWVMEIQADLYFH
DLKFDGAFIINWLERNGFKWSADGLPNTYNTIISRMGQWYMIDICLGYKGKRKIHTVIYDS
LKKLPFPVEKIAKDFKLTVKKGDIDIHKERPVGYKITPEEYAYIKNDIQIIAEALLIQFKQ
GLDRMTAGSDSLKGFKDIITTKKFKKVFPTLSLGLDKEVRKAYRGGFTWLNDRFKGKEIGE
GMVFDANSHYPAQMYVRPLPYGTPLFYEGEYKENIDYPLYIQNIKVRFRLKERHIPTIQVK
QSSLFIQNEYLESSVNKLGVDELIDLTLTNVDLDLFFEHYDILEIHYTYGYMFKASCDMFK
DFIDKWTYIKTTSYGAIKQLAKLMLNSLYGKFASNPDVTGKVPYLKENGALGFRLGEEETK
DPVYTPMGVFITAWGRYTTITAAQACYDRIIYCDTDSIHLTGTEIPDVIKDIVDPKKLGYW
EHESTFKRAKYLRQKTYIQDIYMKRVKGYLVQGSPDDYTDIKFSVKCAGMTDKIKKEVTFE
NFKVGFSRKMKPKPVQVPGGVVLVDETFTIK |
| C0153 | 535 | MSKKMFSCDFETTTKLDDCRVWAYGYMEVGNLDNYKIGNNIDEFMQWIMEIQADLYFHDLK
FDGAFIINWLERNGFKWSADGLPNTYNTIISRMGQWYMIDICLGYKGKRKIHTVIYDSLKK
LPFPVEKIAKDFKLTVKKGDIDIHKERPVGYKITPEEYAYIKNDIQIIAEALLIQFKQGLD
RMTAGSDSLKGFKDIITTKKFKKVFPTLSLGLDKEVRKAYRGGFTWLNDRFKGKEIGEGMV
FDANSHYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YTPMGVFITAWGRYTTITAAQACYDRIIYCDTDSIHLTGTEIPDVIKDIVDPKKLGYWEHE
STFKRAKYLRQKTYIQDIYMKRVKGYLVQGSPDDYTDIKFSVKCAGMTDKIKKEVTFENFK
VGFSRKMKPKPVQVPGGVVLVDETFTIK |
| C0154 | 536 | MSRKMFSCDFETTTKLDDCRVWAYGYMEVGNLDNYKIGNNIDEFMQWIMEIQADLYFHDLK
FDGAFIINWLERNGFKWSADGLPNTYNTIISRMGQWYMIDICLGYKGKRKIHTVIYDSLKK |

TABLE 4-continued

Chimeric Polymerase Variants

| Name | SEQ ID NO | Sequence |
|---|---|---|
| | | LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01555 | 37 | MSRKMFSCDFETTTKLDDCRVWAYGYMELGNLDNYKIGNNIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01565 | 38 | MSRKMFSCDFETTTKLDDCRVWAYGYMELGNLDNYKIGNTIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01575 | 39 | MSRKMFSCDFETTTKLDDCRVWAYGYMEVGNLDNYKIGNTIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01585 | 40 | MSRKMFSCDFETTTKLDDCRVWAYGYMEIGNLDNYKIGNNIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01595 | 41 | MSRKMFSCDFETTTKLDDCRVWAYGYMEIGNLDNYKIGNTIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01605 | 42 | MSRKMFSCDFETTTKLDDCRVWAYGYMEVGNLDNYKIGNTLDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |

TABLE 4-continued

Chimeric Polymerase Variants

| Name | SEQ ID NO | Sequence |
|---|---|---|
| C01615 | 43 | MSRKMFSCDFETTTKLDDCRVWAYGYMEVGNLDNYKIGNSIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01625 | 44 | MSRKMFSCDFETTTKLDDCRVWAYGYMELGNLDNYKIGNSIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01635 | 45 | MHKMSRKRFSCDFETTTKLDDCRVWAYGYMEVGNLDNYKIGNNIDEFMQWAMEIQADLYFH<br>DLKFDGAFIINWLERNGFKWSADGLPNTYNTIISRMGQWYMIDICLGYKGKRKIHTVIYDS<br>LKKLPFPVEKIAKDFKLTVKKGDIDIHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDANSHYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTEIPDVIKDIVDPKKLGYW<br>EHESTFKRAKYLRQKTYIQDIYMKRVKGYLVQGSPDDYTDIKFSVKCAGMTDKIKKEVTFE<br>NFKVGFSRKMKPKPVQVPGGVVLVDETFTIK |
| C01645 | 46 | MSRKRFSCDFETTTKLDDCRVWAYGYMEVGNLDNYKIGNNIDEFMQWAMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01655 | 47 | MSRKRFSCDFETTTKLDDCRVWAYGYMEVGNLDNYKIGNNIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01665 | 48 | MSRKRFSCDFETTTKLDDCRVWAYGYMEVGNLDNYKIGNTIDEFMQWIMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01675 | 49 | MSRKRFSCDFETTTKLDDCRVWAYGYMEVGNLDNYKIGNNIDEFMQWAMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV |

TABLE 4-continued

Chimeric Polymerase Variants

| Name | SEQ ID NO | Sequence |
|---|---|---|
| | | YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C01685 | 50 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C01695 | 51 | MHKMSRKRFSCDFETTTKLDDCRVWAYGYMEVGNLDNYKIGNNIDEFMQWAMEIQADLYFH<br>DLKFDGAFIINWLFKNGFKWCKEAKEERTFSTIISRMGQWYMIDICLGYKGKRKIHTVIYD<br>SLKKLPFPVEKIAKDFKLTVKKGDIDIHKERPVGYKITPEEYAYIKNDIQIIAEALLIQFK<br>QGLDRMTAGSDSLKDFKDIITTKKFKKVFPTLSLGLDKEVRKAYRGGFTWLNDRFKGKEIG<br>EGMVFDANSHYPAQMYVRPLPYGTPLFYEGEYKENIDHPLYIQNLKVRFRLKERHIPCIQV<br>KQSSLFIQNEYLESSVNKLGVDELIELTLTNVDLDLFFEHYEILEIHYTYGYMFRASCDMF<br>KDFIDKWTYIKTTSYGAIKQLAKLMLNSLYGKFASNPDVTGKVPYLKENGALGFRLGEEET<br>KDPVYTPLASFVTAWGRYTTITTAQACYDRIIYCDTDSIHLTGTKIPDVIKDIVHPKKLGY<br>WEHESTFKRAKYLRQKTYIQDIYMKRVKGYLVQGSPDDYTDIKFSVKCAGMTDKIKEEVTF<br>ENFKVGFSRKMKPKPVQVPGGVVLVDSVFTIK |
| C01705 | 52 | MHKMSRKRFSCDFETTTKLDDCRVWAYGYMEVGNLDNYKIGNNIDEFMQWAMEIQADLYFH<br>DLKFDGAFIVNWLFKNGFKWCKEAKEERTFSTIISRMGQWYMIDICIGYKGKRKIHTVIYD<br>SLKKLPFPVEKIAKDFKLTVKKGDIDIHKERPVGYKITPEEYAYIKNDIQIIAEALLIQFK<br>QGLDRMTAGSDSLKDFKDIITTKKFKKVFPTLSLGLDKEVRKAYRGGFTWLNDRFKGKEIG<br>EGMVFDANSHYPAQMYVRPLPYGTPLFYEGEYKENIDHPLYIQNLKVRFRLKERHIPCIQV<br>KQSSLFIQNEYLESSVNKLGVDELIELTLTNVDLDLFFEHYEILEIHYTYGYMFRASCDMF<br>KDFIDKWTYIKTTSYGAIKQLAKLMLNSLYGKFASNPDVTGKVPYLKENGALGFRLGEEET<br>KDPVYTPLASFVTAWGRYTTITTAQACYDRIIYCDTDSIHLTGTKIPDVIKDIVHPKKLGY<br>WEHESTFKRAKYLRQKTYIQDIYMKRVKGYLVQGSPDDYTDIKFSVKCAGMTDKIKEEVTF<br>ENFKVGFSRKMKPKPVQVPGGVVLVDSVFTIK |
| C01715 | 53 | MHKMSRKRFSCDFETTTKLDDCRVWAYGYMEVGNLDNYKIGNNIDEFMQWAMEIQADLYFH<br>DLKFDGAFIVNWLFKNGFKWCKEAKEERTFSTIISRMGQWYMIDICIGYKGKRKIHTVIYD<br>SLKKLPFPVEKIAKDFKLTVKKGDIDIHKERPVGYKITPEEYAYIKNDIQIIAEALLIQFK<br>QGLDRMTAGSDSLKDFKDIITTKKFKKVFPTLSLGLDKEVRKAYRGGFTWLNDRFKGKEIG<br>EGMVFDANSHYPAQMYVRPLPYGTPLFYQGEYKENIDHPLYIQNLKVRFRLKERHIPCIQV<br>KQNSLFIQNEYLESSVNKLGVDELIELTLTNVDLDLFFEHYEILEIHYTYGYMFRASCDMF<br>KDFIDKWTYIKTTSYGAIKQLAKLMLNSLYGKFASNPDVTGKVPYLKENGALGFRLGEEET<br>KDPVYTPLASFVTAWGRYTTITTAQACYDRIIYCDTDSIHLTGTKIPDVIKDIVHPKKLGY<br>WEHESTFKRAKYLRQKTYIQDIYMKRVKGYLVQGSPDDYTDIKFSVKCAGMTDKIKEEVTF<br>ENFKVGFSRKMKPKPVQVPGGVVLVDSVFTIK |
| C01725 | 54 | MHKMSRKRFSCDFETTTKLDDCRVWAYGYMEVGNLDNYKIGNNIDEFMQWAMEIQADLYFH<br>DLKFDGAFIVNWLFKNGFKWCKEAKEERTFSTIISRMGQWYMIDICIGYKGKRKIHTVIYD<br>SLKKLPFPVEKIAKDFKLTVKKGDIDIHKERPVGYKITPEEYAYIKNDIQIIAEALLIQFK<br>QGLDRMTAGSDSLKDFKDIITTKKFKKVFPTLSLGLDKEVRKAYRGGFTWLNDRFKGKEIG<br>EGMVFDANSHYPAQMYVRPLPYGTPLFYQGEYKENIDHPLYIQNLKVRFRLKERHIPCIQV<br>KQSSLFIQNEYLESSVNKLGVDELIELTLTNVDLDLFFEHYEILEIHYTYGYMFRASCDMF<br>KDFIDKWTYIKTTSYGAIKQLAKLMLNSLYGKFASNPDVTGKVPYLKENGALGFRLGEEET<br>KDPVYTPLASFVTAWGRYTTITTAQACYDRIIYCDTDSIHLTGTKIPDVIKDIVHPKKLGY<br>WEHESTFKRAKYLRQKTYIQDIYMKRVKGYLVQGSPDDYTDIKFSVKCAGMTDKIKEEVTF<br>ENFKVGFSRKMKPKPVQVPGGVVLVDSVFTIK |
| C01735 | 55 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C01745 | 56 | MHKMSKKMFSCDFETTTKLDDCRVWAYGYMEVGNLDNYKIGNNIDEFMQWIMEIQADLYFH<br>DLKFDGAFIINWLFKNGFKWCKEAKEERTFSTIISRMGQWYMIDICLGYKGKRKIHTVIYD<br>SLKKLPFPVEKIAKDFKLTVKKGDIDIHKERPVGYKITPEEYAYIKNDIQIIAEALLIQFK<br>QGLDRMTAGSDSLKDFKDIITTKKFKKVFPTLSLGLDKEVRKAYRGGFTWLNDRFKGKEIG |

TABLE 4-continued

Chimeric Polymerase Variants

| Name | SEQ ID NO | Sequence |
|---|---|---|

EGMVFDANSHYPAQMYVRPLPYGTPLFYEGEYKENIDHPLYIQNLKVRFRLKERHIPCIQV
KQSSLFIQNEYLESSVNKLGVDELIELTLTNVDLDLFFEHYEILEIHYTYGYMFRASCDMF
KDFIDKWTYIKTTSYGAIKQLAKLMLNSLYGKFASNPDVTGKVPYLKENGALGFRLGEEET
KDPVYTPLASFVTAWGRYTTITTAQACYDRIIYCDTDSIHLTGTKIPDVIKDIVHPKKLGY
WEHESTFKRAKYLRQKTYIQDIYMKRVKGYLVQGSPDDYTDIKFSVKCAGMTDKIKEEVTF
ENFKVGFSRKMKPKPVQVPGGVVLVDSVFTIK

C0175557  MSRKRFSCDFETTTKLDDCRVWAYGYMEIGNLDNYKIGNSLDEFMQWAMEIQADLYFFHDL
KFDGAFIVNWLFKNGFKWCKEAKEERTFSTIISRMGQWYMIDICIGYKGKRKIHTVIYDSL
KKLPFPVEKIAKDFKLTVKKGDIDIHKERPVGYKITPEEYAYIKNDIQIIAEALLIQFKQG
LDRMTAGSDSLKDFKDIITTKKFKKVFPTLSLGLDKEVRKAYRGGFTWLNDRFKGKEIGEG
MVFDANSHYPAQMYVRPLPYGTPLFYQGEYKENIDHPLYIQNLKVRFRLKERHIPCIQVKQ
NSLFIQNEYLESSVNKLGVDELIELTLTNVDLDLFFEHYEILEIHYTYGYMFRASCDMFKD
FIDKWTYIKTTSYGAIKQLAKLMLNSLYGKFASNPDVTGKVPYLKENGALGFRLGEEETKD
PVYTPLASFVTAWGRYTTITTAQACYDRIIYCDTDSIHLTGTKVPDIIKDLVHPKKLGYWE
HESTFKRAKYLRQKTYIQDIYMKRVKGYLVQGSPDDYTDIKFSVKCAGMTDKIKEEVTFEN
FKVGFSRKMKPKPVQVPGGVVLVDSVFTIK

C0176558  MSRKRFSCDFETTTKLDDCRVWAYGYMEIGNLDNYKIGNSLDEFMQWAMEIQADLYFFHDL
KFDGAFIVNWLFKNGFKWCKEAKEERTFSTIISRMGQWYMIDICIGYKGKRKIHTVIYDSL
KKLPFPVEKIAKDFKLTVKKGDIDIHKERPVGYKITPEEYAYIKNDIQIIAEALLIQFKQG
LDRMTAGSDSLKDFKDIITTKKFKKVFPTLSLGLDKEVRKAYRGGFTWLNDRFKGKEIGEG
MVFDANSHYPAQMYVRPLPYGTPLFYQGEYKENIDHPLYIQNLKVRFRLKERHIPCIQVKQ
NSLFIQNEYLESSVNKLGVDELIELTLTNVDLDLFFEHYEILEIHYTYGYMFRASCDMFKD
FIDKWTYIKTTSYGAIKQLAKLMLNSLYGKFASNPDVTGKVPYLKENGALGFRLGEEETKD
PVYTPLASFVTAWGRYTTITTAQACYDRIIYCDTDSIHLTGTKVPDAIKDLVHPKKLGYWE
HESTFKRAKYLRQKTYIQDIYMKRVKGYLVQGSPDDYTDIKFSVKCAGMTDKIKEEVTFEN
FKVGFSRKMKPKPVQVPGGVVLVDSVFTIK

C0177559  MSRKRFSCDFETTTKLDDCRVWAYGYMEIGNLDNYKIGNSLDEFMQWAMEIQADLYFFHDL
KFDGAFIVNWLFKNGFKWCKEAKEERTFSTIISRMGQWYMIDICIGYKGKRKIHTVIYDSL
KKLPFPVEKIAKDFKLTVKKGDIDIHKERPVGYKITPEEYAYIKNDIQIIAEALLIQFKQG
LDRMTAGSDSLKDFKDIITTKKFKKVFPTLSLGLDKEVRKAYRGGFTWLNDRFKGKEIGEG
MVFDANSHYPAQMYVRPLPYGTPLFYQGEYKENIDHPLYIQNLKVRFRLKERHIPCIQVKQ
NSLFIQNEYLESSVNKLGVDELIELTLTNVDLDLFFEHYEILEIHYTYGYMFRASCDMFKD
FIDKWTYIKTTSYGAIKQLAKLMLNSLYGKFASNPDVTGKVPYLKENGALGFRLGEEETKD
PVYTPLASFVTAWGRYTTITTAQACYDRIIYCDTDSIHLTGTKVPDAIKDLVHPKKLGYWE
HESTFKRAKYLRQKTYVQDIYMKRVKGYLVQGSPDDYTDIKFSVKCAGMTDKIKEEVTFEN
FKVGFSRKMKPKPVQVPGGVVLVDSVFTIK

C0178560  MSRKRFSCDFETTTKLDDCRVWAYGYMEIGNLDNYKIGNSLDEFMQWAMEIQADLYFFHDL
KFDGAFIVNWLFKNGFKWCKEAKEERTFSTIISRMGQWYMIDICIGYKGKRKIHTVIYDSL
KKLPFPVEKIAKDFKLTVKKGDIDIHKERPVGYKITPEEYAYIKNDIQIIAEALLIQFKQG
LDRMTAGSDSLKDFKDIITTKKFKKVFPTLSLGLDKEVRKAYRGGFTWLNDRFKGKEIGEG
MVFDANSHYPAQMYVRPLPYGTPLFYQGEYKENIDHPLYIQNLKVRFRLKERHIPCIQVKQ
NSLFIQNEYLESSVNKLGVDELIELTLTNVDLDLFFEHYEILEIHYTYGYMFRASCDMFKD
FIDKWTYIKTTSYGAIKQLAKLMLNSLYGKFASNPDVTGKVPYLKENGALGFRLGEEETKD
PVYTPLASFVTAWGRYTTITTAQACYDRIIYCDTDSIHLTGTKVPDIIKDIVHPKKLGYWE
HESTFKRAKYLRQKTYIQDIYMKRVKGYLVQGSPDDYTDTKFSVKCAGMTDKIKEEVTFEN
FKVGFSRKMKPKPVQVPGGVVLVDSVFTIK

C0179561  MSRKRFSCDFETTTKLDDCRVWAYGYMEIGNLDNYKIGNSLDEFMQWAMEIQADLYFFHDL
KFDGAFIVNWLFKNGFKWCKEAKEERTFSTIISRMGQWYMIDICIGYKGKRKIHTVIYDSL
KKLPFPVEKIAKDFKLTVKKGDIDIHKERPVGYKITPEEYAYIKNDIQIIAEALLIQFKQG
LDRMTAGSDSLKDFKDIITTKKFKKVFPTLSLGLDKEVRKAYRGGFTWLNDRFKGKEIGEG
MVFDANSHYPAQMYVRPLPYGTPLFYQGEYKENIDHPLYIQNLKVRFRLKERHIPCIQVKQ
NSLFIQNEYLESSVNKLGVDELIELTLTNVDLDLFFEHYEILEIHYTYGYMFRASCDMFKD
FIDKWTYIKTTSYGAIKQLAKLMLNSLYGKFASNPDVTGKVPYLKENGALGFRLGEEETKD
PVYTPLASFVTAWGRYTTITTAQACYDRIIYCDTDSIHLTGTKVPDAIKDIVHPKKLGYWE
HESTFKRAKYLRQKTYIQDIYMKRVKGYLVQGSPDDYTDGKFSVKCAGMTDKIKEEVTFEN
FKVGFSRKMKPKPVQVPGGVVLVDSVFTIK

C0180562  MSRKRFSCDFETTTKLDDCRVWAYGYMEIGNLDNYKIGNSLDEFMQWAMEIQADLYFFHDL
KFDGAFIVNWLFKNGFKWCKEAKEERTFSTIISRMGQWYMIDICIGYKGKRKIHTVIYDSL
KKLPFPVEKIAKDFKLTVKKGDIDIHKERPVGYKITPEEYAYIKNDIQIIAEALLIQFKQG
LDRMTAGSDSLKDFKDIITTKKFKKVFPTLSLGLDKEVRKAYRGGFTWLNDRFKGKEIGEG

TABLE 4-continued

Chimeric Polymerase Variants

| Name | SEQ ID NO | Sequence |
|---|---|---|
| | | MVFDANSHYPAQMYVRPLPYGTPLFYQGEYKENIDHPLYIQNLKVRFRLKERHIPCIQVKQ<br>NSLFIQNEYLESSVNKLGVDELIELTLTNVDLDLFFEHYEILEIHYTYGYMFRASCDMFKD<br>FIDKWTYIKTTSYGAIKQLAKLMLNSLYGKFASNPDVTGKVPYLKENGALGFRLGEEETKD<br>PVYTPLASFVTAWGRYTTITTAQACYDRIIYCDTDSIHLTGTKVPDAIKDLVHPKKLGYWE<br>HESTFKRAKYLRQKTYIQDIYMKRVKGYLVQGSPDDYTDGKFSVKCAGMTDKIKEEVTFEN<br>FKVGFSRKMKPKPVQVPGGVVLVDSVFTIK |
| C0181563 | | MSRKRFSCDFETTTKLDDCRVWAYGYMEIGNLDNYKIGNSLDEFMQWAMEIQADLYFFHDL<br>KFDGAFIVNWLFKNGFKWCKEAKEERTFSTIISRMGQWYMIDICIGYKGKRKIHTVIYDSL<br>KKLPFPVEKIAKDFKLTVKKGDIDIHKERPVGYKITPEEYAYIKNDIQIIAEALLIQFKQG<br>LDRMTAGSDSLKDFKDIITTKKFKKVFPTLSLGLDKEVRKAYRGGFTWLNDRFKGKEIGEG<br>MVFDANSHYPAQMYVRPLPYGTPLFYQGEYKENIDHPLYVQNLKVRFRLKERHIPCIQVKQ<br>NSLFIQNEYLESSVNKLGVDELIEITLTNVDVDLFFEHYEILEIHYTYGYMFRASCDMFKD<br>FIDKWTYIKTTSYGAIKQLAKLMLNSLYGKFASNPDVTGKVPYLKENGALGFRLGEEETKD<br>PVYTPLASFVTAWGRYTTITTAQACYDRIIYCDTDSIHLTGTKIPDVIKDIVHPKKLGYWE<br>HESTFKRAKYLRQKTYIQDIYMKRVKGYLVQGSPDDYTDIKFSVKCAGMTDKIKEEVTFEN<br>FKVGFSRKMKPKPVQVPGGVVLVDSVFTIK |
| C0182564 | | MSRKRFSCDFETTTKLDDCRVWAYGYMEIGNLDNYKIGNSLDEFMQWAMEIQADLYFFHDL<br>KFDGAFIVNWLFKNGFKWCKEAKEERTFSTIISRMGQWYMIDICIGYKGKRKLHTVIYDSL<br>KKLPFPVEKIAKDFKLTVKKGDIDIHKERPVGYKITPEEYAYIKNDIQIIAEALLIQFKQG<br>LDRMTAGSDSLKDFKDIITTKKFKKVFPTLSLGLDKEVRKAYRGGFTWLNDRFKGKEIGEG<br>MVFDANSHYPAQMYVRPLPYGTPLFYQGEYKENIDHPLYVQNLKVRFRLKERHIPCIQVKQ<br>NSLFIQNEYLESSVNKLGVDELIEITLTNVDVDLFFEHYEILEIHYTYGYMFRASCDMFKD<br>FIDKWTYIKTTSYGAIKQLAKLMLNSLYGKFASNPDVTGKVPYLKENGALGFRLGEEETKD<br>PVYTPLASFVTAWGRYTTITTAQACYDRIIYCDTDSIHLTGTKIPDVIKDIVHPKKLGYWE<br>HESTFKRAKYLRQKTYIQDIYMKRVKGYLVQGSPDDYTDIKFSVKCAGMTDKIKEEVTFEN<br>FKVGFSRKMKPKPVQVPGGVVLVDSVFTIK |
| C0183565 | | MSRKRFSCDFETTTKLDDCRVWAYGYMEIGNLDNYKIGNSLDEFMQWAMEIQADLYFFHDL<br>KFDGAFIVNWLFKNGFKWCKEAKEERTFSTIISRMGQWYMIDICIGYKGKRKQHTVIYDSL<br>KKLPFPVEKIAKDFKLTVKKGDIDIHKERPVGYKITPEEYAYIKNDIQIIAEALLIQFKQG<br>LDRMTAGSDSLKDFKDIITTKKFKKVFPTLSLGLDKEVRKAYRGGFTWLNDRFKGKEIGEG<br>MVFDANSHYPAQMYVRPLPYGTPLFYQGEYKENIDHPLYVQNLKVRFRLKERHIPCIQVKQ<br>NSLFIQNEYLESSVNKLGVDELIEITLTNVDVDLFFEHYEILEIHYTYGYMFRASCDMFKD<br>FIDKWTYIKTTSYGAIKQLAKLMLNSLYGKFASNPDVTGKVPYLKENGALGFRLGEEETKD<br>PVYTPLASFVTAWGRYTTITTAQACYDRIIYCDTDSIHLTGTKIPDVIKDIVHPKKLGYWE<br>HESTFKRAKYLRQKTYIQDIYMKRVKGYLVQGSPDDYTDIKFSVKCAGMTDKIKEEVTFEN<br>FKVGFSRKMKPKPVQVPGGVVLVDSVFTIK |
| C0184566 | | MSRKRFSCDFETTTKLDDCRVWAYGYMEIGNLDNYKIGNSLDEFMQWAMEIQADLYFFHDL<br>KFDGAFIVNWLFKNGFKWCKEAKEERTFSTIISRMGQWYMIDICIGYKGKRKIHTVIYDSL<br>KKLPFPVEKIAKDFKLTVKKGDIDIHKERPVGYKITPEEYAYIKNDIQIIAEALLIQFKQG<br>LDRMTAGSDSLKDFKDIITTKKFKKVFPTLSLGLDKEVRKAYRGGFTWLNDRFKGKEIGEG<br>MVFDANSHYPAQMYVRPLPYGTPLFYQGEYKENIDHPLYIQNLKVRFRLKERHIPCIQVKQ<br>NSLFIQNEYLESSVNKLGVDELIELTVTNVDLDLFFEHYEILEIHYTYGYMFRGSCDMFKD<br>FIDKWTYIKTTSYGAIKQLAKLMLNSLYGKFASNPDVTGKVPYLKENGALGFRLGEEETKD<br>PVYTPLASFVTAWGRYTTITTAQACYDRIIYCDTDSIHLTGTKVPDVIKDIVHPKKLGYWE<br>HESTFKRAKYLRQKTYIQDIYMKRVKGYLVQGSPDDYTDIKFSVKCAGMTDKIKEEVTFEN<br>FKVGFSRKMKPKPVQVPGGVVLVDSVFTIK |
| C0185567 | | MSRKRFSCDFETTTKLDDCRVWAYGYMEIGNLDNYKIGNSLDEFMQWAMEIQADLYFFHDL<br>KFDGAFIVNWLFKNGFKWCKEAKEERTFSTIISRMGQWYMIDICIGYKGKRKIHTVIYDSL<br>KKLPFPVEKIAKDFKLTVKKGDIDIHKERPVGYKITPEEYAYIKNDIQIIAEALLIQFKQG<br>LDRMTAGSDSLKDFKDIITTKKFKKVFPTLSLGLDKEVRKAYRGGFTWLNDRFKGKEIGEG<br>MVFDANSHYPAQMYVRPLPYGTPLFYQGEYKENIDHPLYIQNLKVRFRLKERHIPCIQVKQ<br>NSLFIQNEYLESSVNKLGVDELIELTVTNVDLDLFFEHYEILEIHYTYGYMFRSSCDMFKD<br>FIDKWTYIKTTSYGAIKQLAKLMLNSLYGKFASNPDVTGKVPYLKENGALGFRLGEEETKD<br>PVYTPLASFVTAWGRYTTITTAQACYDRIIYCDTDSIHLTGTKVPDVIKDIVHPKKLGYWE<br>HESTFKRAKYLRQKTYIQDIYMKRVKGYLVQGSPDDYTDIKFSVKCAGMTDKIKEEVTFEN<br>FKVGFSRKMKPKPVQVPGGVVLVDSVFTIK |
| C0186568 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP |

TABLE 4-continued

Chimeric Polymerase Variants

| Name | SEQ ID NO | Sequence |
|---|---|---|
| | | VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0187 | 569 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0188 | 570 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0189 | 571 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDPLYIQNIKVRFRLKERHIPTIQVKQSS<br>LFIQNEYLESSVNKLGVDLTLTLTNVDLDLFFEHYDILEIHYTYGYMFKASCDMFKDFI<br>DKWFYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0190 | 572 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0191 | 573 | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDIIKDLVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0192 | 574 | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDAIKDLVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0193 | 575 | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM |

TABLE 4-continued

Chimeric Polymerase Variants

| Name | SEQ ID NO | Sequence |
|---|---|---|

```
              VFDANSHYPAQMYVRPLPYGTPLFYQGEYKENIDHPLYIQNLKVRFRLKERHIPCIQVKQN
              SLFIQNEYLESSVNKLGVDELIELTLTNVDLDLFFEHYEILEIHYTYGYMFRASCDMFKDF
              IDKWTYIKTTSYGAIKQLAKLMLNSLYGKFASNPDVTGKVPYLKENGALGFRLGEEETKDP
              VYTPLASFVTAWGRYTTITTAQACYDRIIYCDTDSIHLTGTKVPDAIKDLVHPKKLGYWEH
              ESTFKRAKYLRQKTYVQDIYMKRVKGYLVQGSPDDYTDIKFSVKCAGMTDKIKEEVTFENF
              KVGFSRKMKPKPVQVPGGVVLVDSVFTIK

C0194576      MSRKRFSCDFETTTKLDDCRVWAYGYMEIGNLDNYKIGNSLDEFMQWAMEIQADLYFHNLK
              FDGAFIVNWLFKNGFKWCKEAKEERTFSTIISRMGQWYMIDICIGYKGKRKIHTVIYDSLK
              KLPFPVEKIAKDFKLTVKKGDIDIHKERPVGYKITPEEYAYIKNDIQIIAEALLIQFKQGL
              DRMTAGSDSLKDFKDIITTKKFKKVFPTLSLGLDKEVRKAYRGGFTWLNDRFKGKEIGEGM
              VFDANSHYPAQMYVRPLPYGTPLFYQGEYKENIDHPLYIQNLKVRFRLKERHIPCIQVKQN
              SLFIQNEYLESSVNKLGVDELIELTLTNVDLDLFFEHYEILEIHYTYGYMFRASCDMFKDF
              IDKWTYIKTTSYGAIKQLAKLMLNSLYGKFASNPDVTGKVPYLKENGALGFRLGEEETKDP
              VYTPLASFVTAWGRYTTITTAQACYDRIIYCDTDSIHLTGTKVPDIIKDIVHPKKLGYWEH
              ESTFKRAKYLRQKTYIQDIYMKRVKGYLVQGSPDDYTDTKFSVKCAGMTDKIKEEVTFENF
              KVGFSRKMKPKPVQVPGGVVLVDSVFTIK

C0195577      MSRKRFSCDFETTTKLDDCRVWAYGYMEIGNLDNYKIGNSLDEFMQWAMEIQADLYFHNLK
              FDGAFIVNWLFKNGFKWCKEAKEERTFSTIISRMGQWYMIDICIGYKGKRKIHTVIYDSLK
              KLPFPVEKIAKDFKLTVKKGDIDIHKERPVGYKITPEEYAYIKNDIQIIAEALLIQFKQGL
              DRMTAGSDSLKDFKDIITTKKFKKVFPTLSLGLDKEVRKAYRGGFTWLNDRFKGKEIGEGM
              VFDANSHYPAQMYVRPLPYGTPLFYQGEYKENIDHPLYIQNLKVRFRLKERHIPCIQVKQN
              SLFIQNEYLESSVNKLGVDELIELTLTNVDLDLFFEHYEILEIHYTYGYMFRASCDMFKDF
              IDKWTYIKTTSYGAIKQLAKLMLNSLYGKFASNPDVTGKVPYLKENGALGFRLGEEETKDP
              VYTPLASFVTAWGRYTTITTAQACYDRIIYCDTDSIHLTGTKVPDAIKDIVHPKKLGYWEH
              ESTFKRAKYLRQKTYIQDIYMKRVKGYLVQGSPDDYTDGKFSVKCAGMTDKIKEEVTFENF
              KVGFSRKMKPKPVQVPGGVVLVDSVFTIK

C0196578      MSRKRFSCDFETTTKLDDCRVWAYGYMEIGNLDNYKIGNSLDEFMQWAMEIQADLYFHNLK
              FDGAFIVNWLFKNGFKWCKEAKEERTFSTIISRMGQWYMIDICIGYKGKRKIHTVIYDSLK
              KLPFPVEKIAKDFKLTVKKGDIDIHKERPVGYKITPEEYAYIKNDIQIIAEALLIQFKQGL
              DRMTAGSDSLKDFKDIITTKKFKKVFPTLSLGLDKEVRKAYRGGFTWLNDRFKGKEIGEGM
              VFDANSHYPAQMYVRPLPYGTPLFYQGEYKENIDHPLYIQNLKVRFRLKERHIPCIQVKQN
              SLFIQNEYLESSVNKLGVDELIELTLTNVDLDLFFEHYEILEIHYTYGYMFRASCDMFKDF
              IDKWTYIKTTSYGAIKQLAKLMLNSLYGKFASNPDVTGKVPYLKENGALGFRLGEEETKDP
              VYTPLASFVTAWGRYTTITTAQACYDRIIYCDTDSIHLTGTKVPDAIKDLVHPKKLGYWEH
              ESTFKRAKYLRQKTYIQDIYMKRVKGYLVQGSPDDYTDGKFSVKCAGMTDKIKEEVTFENF
              KVGFSRKMKPKPVQVPGGVVLVDSVFTIK

C0197579      MSRKRFSCDFETTTKLDDCRVWAYGYMEIGNLDNYKIGNSLDEFMQWAMEIQADLYFHNLK
              FDGAFIVNWLFKNGFKWCKEAKEERTFSTIISRMGQWYMIDICIGYKGKRKIHTVIYDSLK
              KLPFPVEKIAKDFKLTVKKGDIDIHKERPVGYKITPEEYAYIKNDIQIIAEALLIQFKQGL
              DRMTAGSDSLKDFKDIITTKKFKKVFPTLSLGLDKEVRKAYRGGFTWLNDRFKGKEIGEGM
              VFDANSHYPAQMYVRPLPYGTPLFYQGEYKENIDHPLYVQNLKVRFRLKERHIPCIQVKQN
              SLFIQNEYLESSVNKLGVDELIEITLTNVDVDLFFEHYEILEIHYTYGYMFRASCDMFKDF
              IDKWTYIKTTSYGAIKQLAKLMLNSLYGKFASNPDVTGKVPYLKENGALGFRLGEEETKDP
              VYTPLASFVTAWGRYTTITTAQACYDRIIYCDTDSIHLTGTKIPDVIKDIVHPKKLGYWEH
              ESTFKRAKYLRQKTYIQDIYMKRVKGYLVQGSPDDYTDIKFSVKCAGMTDKIKEEVTFENF
              KVGFSRKMKPKPVQVPGGVVLVDSVFTIK

C0198580      MSRKRFSCDFETTTKLDDCRVWAYGYMEIGNLDNYKIGNSLDEFMQWAMEIQADLYFHNLK
              FDGAFIVNWLFKNGFKWCKEAKEERTFSTIISRMGQWYMIDICIGYKGKRKLHTVIYDSLK
              KLPFPVEKIAKDFKLTVKKGDIDIHKERPVGYKITPEEYAYIKNDIQIIAEALLIQFKQGL
              DRMTAGSDSLKDFKDIITTKKFKKVFPTLSLGLDKEVRKAYRGGFTWLNDRFKGKEIGEGM
              VFDANSHYPAQMYVRPLPYGTPLFYQGEYKENIDHPLYVQNLKVRFRLKERHIPCIQVKQN
              SLFIQNEYLESSVNKLGVDELIEITLTNVDVDLFFEHYEILEIHYTYGYMFRASCDMFKDF
              IDKWTYIKTTSYGAIKQLAKLMLNSLYGKFASNPDVTGKVPYLKENGALGFRLGEEETKDP
              VYTPLASFVTAWGRYTTITTAQACYDRIIYCDTDSIHLTGTKIPDVIKDIVHPKKLGYWEH
              ESTFKRAKYLRQKTYIQDIYMKRVKGYLVQGSPDDYTDIKFSVKCAGMTDKIKEEVTFENF
              KVGFSRKMKPKPVQVPGGVVLVDSVFTIK

C0199581      MSRKRFSCDFETTTKLDDCRVWAYGYMEIGNLDNYKIGNSLDEFMQWAMEIQADLYFHNLK
              FDGAFIVNWLFKNGFKWCKEAKEERTFSTIISRMGQWYMIDICIGYKGKRKQHTVIYDSLK
              KLPFPVEKIAKDFKLTVKKGDIDIHKERPVGYKITPEEYAYIKNDIQIIAEALLIQFKQGL
              DRMTAGSDSLKDFKDIITTKKFKKVFPTLSLGLDKEVRKAYRGGFTWLNDRFKGKEIGEGM
```

TABLE 4-continued

Chimeric Polymerase Variants

| Name | SEQ ID NO | Sequence |
|---|---|---|
| | | VFDANSHYPAQMYVRPLPYGTPLFYQGEYKENIDHPLYVQNLKVRFRLKERHIPCIQVKQN<br>SLFIQNEYLESSVNKLGVDELIEITLTNVDVDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0200582 | | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTVTNVDLDLFFEHYEILEIHYTYGYMFRGSCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0201583 | | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTVTNVDLDLFFEHYEILEIHYTYGYMFRSSCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0202584 | | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDIIKDLVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0203585 | | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDAIKDLVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0204586 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYSRLLPYGEPIVFEGKYVWDEDYPLHIQIRCEFELKEGYIPTIQIKRS<br>RFYKGNEYLKSSGGEIADLWLSNVDLELMKEHYDLNVEYISGLKFKATTGLFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |

TABLE 4-continued

Chimeric Polymerase Variants

| Name | SEQ ID NO | Sequence |
|---|---|---|
| C0205587 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDVNSMYPAMMKNKLLPYGEPVMFKGEYKKNVEYPLYIQQVRCFFELKKDKIPCIQIKGN<br>ARFGQNEYLSTSGDEYVDLYVTNVDWELIKKHYDIFEEEFIGGFMFKGFIGFFDEYIDRFM<br>EIKNSPDSSAEQSLQAKLMLNSLYGKFASNPDVTGKVPYLKENGALGFRLGEEETKDPVYT<br>PLASFVTAWGRYTTITTAQACYDRIIYCDTDSIHLTGTKIPDVIKDIVHPKKLGYWEHEST<br>FKRAKYLRQKTYIQDIYMKRVKGYLVQGSPDDYTDIKFSVKCAGMTDKIKEEVTFENFKVG<br>FSRKMKPKPVQVPGGVVLVDSVFTIK |
| C0206588 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKKNVEYPLYIQQVRCFFELKKDKIPCIQIKGN<br>ARFGQNEYLSTSGDEYVDLYVTNVDWELIKKHYDIFEEEFIGGFMFKGFIGFFDDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C0207589 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYSRPLPYGAPIVFQGKYEKDEQYPLYIQRIRFEFELKEGYIPTIQIKKN<br>PFFKGNEYLKNSGVEPVELYLTNVDLELIQEHYELYNVEYIDGFKFREKTGLFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C0208590 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0209591 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKPNNDYPLYIQNIKVRFRLKEGYIPTIQVKQS<br>SLFIQNEYLDSSVNKLGVDELIDLTLTNVDLELFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0210592 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRPLPYGTPLFYEGEYKENIDHPLYIQNLKVRFRLKEGYIPTIQIKRS<br>RFYKGNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0211593 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRPLPYGTPLFYEGEYKENIDHPLYIQNLKVRFRLKEGYIPTIQIKRS<br>RFYKGNEYLKSSGGELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPL |

TABLE 4-continued

Chimeric Polymerase Variants

| Name | SEQ ID NO | Sequence |
|---|---|---|
| | | ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02125 | 94 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRPLPYGTPLFYEGEYKENIDHPLYIQNLKVRFRLKEGYIPTIQIKRS<br>RFYKGNEYLKSSGGELIELTLTNVDLELMKEHYEILEIHYTYGYMFRASCDMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02135 | 95 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRLLPYGEPLFYEGEYKENIDHPLYIQNLKVRFRLKEGYIPTIQIKRS<br>RFYKGNEYLKSSGGELIELTLTNVDLELMKEHYEILEIHYTYGYMFKATTGMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02145 | 96 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRLLPYGEPLFYEGEYKENIDHPLYIQNLKVRFRLKERHIPCIQVKQS<br>SLFIQNEYLESSVNKLGVDELIELTLTNVDLDLFFEHYEILEIHYTYGYMFKATTGMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02155 | 97 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRLLPYGEPLFYEGEYKENIDHPLYIQNLKVRFRLKEGYIPTIQIKRS<br>RFYKGNEYLKSSGGELIELTLTNVDLDLFFEHYEILEIHYTYGYMFKATTGMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02165 | 98 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKRS<br>RLFIQNEYLESSVNELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02175 | 99 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKRS<br>RLFKQNEYLESSVNELIELTLTNVDLDLFFEHYEILEIHYTYGYMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02186 | 00 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM |

TABLE 4-continued

Chimeric Polymerase Variants

| Name | SEQ ID NO | Sequence |
|---|---|---|
| | | VFDANSHYPAQMYVRPLPYGTPLFYEGEYKENIDHPLYIQNLKVRFRLKERHIPCIQVKRS<br>RLYKQNEYLESSVNELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02196 | 01 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKRS<br>RFYKGNEYLESSVNELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02206 | 02 | MSRKRFSCDFETTTKLDDCRVWAYGYMEIGNLDNYKIGNSLDEFMQWAMEIQADLYFHNLK<br>FDGAFIINWLFKNGFKWCKEAKEERTESTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKRS<br>RLFKQNEYLESSVNELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02216 | 03 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGLPVPFSGEYEYDETHPLFIQHIKCGFELKDGHIPTIQIKKN<br>FRFADNEYLHSSEGNILDLHVTNVDLALIKEHYTLYEEEYLQGYKFKQVTGLFKNYIDYWS<br>DKKINAEDPAIRQMAKLMLNSLYGKFASNPDVTGKVPYLKENGALGFRLGEEETKDPVYTP<br>LASFVTAWGRYTTITTAQACYDRIIYCDTDSIHLTGTKIPDVIKDIVHPKKLGYWEHESTF<br>KRAKYLRQKTYIQDIYMKRVKGYLVQGSPDDYTDIKFSVKCAGMTDKIKEEVTFENFKVGF<br>SRKMKPKPVQVPGGVVLVDSVFTIK |
| C02226 | 04 | MSRKRFSCDFETTTKLDDCRVWAYGYMEIGNLDNYKIGNSLDEFMQWAMEIQADLYFHDLK<br>FDGAFIVNWLEKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKEKKVFPTLSLGLDKEVRKAYRGGFTWLNDRFKGKEIGEGM<br>VFDANSAYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02236 | 05 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICIGYKOKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKEKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02246 | 06 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPL |

TABLE 4-continued

Chimeric Polymerase Variants

| Name | SEQ ID NO | Sequence |
|---|---|---|

ASFVTAWGRYTTITTAQACYDRIIYCDTDSIHLTGTKIPDVIKDIVHPKKLGYWEHESTFK
RAKYLRQKTYIQDIYMKRVKGYLVQGSPDDYTDIKFSVKCAGMTDKIKEEVTFENFKVGFS
RKMKPKPVQVPGGVVLVDSVFTIK

C02256 607 MSRKRFSCDFETTTKLDDCRVWAYGYMEIGNLDNYKIGNSLDEFMQWAMEIQADLYFHDLK
FDGAFIVNWLFKNGFKWCKEAKEERTFSTIISRMGQWYMIDICIGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSHYPAQMYVRPLPYGTPLFYQGEYKENIDHPLYIQNLKVRFRLKERHIPCIQVKQN
SLFIQNEYLESSVNKLGVDELIELTLTNVDLDLFFEHYEILEIHYTYGYMFRASCDMFKDF
IDKWTYIKTTSYGAIKQLAKLMLNSLYGKFASNPDVTGKVPYLKENGALGFRLGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK

C02266 608 MSRKRFSCDFETTTKLDDCRVWAYGYMEIGNLDNYKIGNSLDEFMQWAMEIQADLYFHDLK
FDGAFIVNWLFKNGFKWCKEAKEERTFSTIISRMGQWYMIDICIGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYQGEYKENIDHPLYIQNLKVRFRLKERHIPCIQVKQN
SLFIQNEYLESSVNKLGVDELIELTLTNVDLDLFFEHYEILEIHYTYGYMFRASCDMFKDF
IDKWTYIKTTSYGAIKQLAKLMLNSLYGKFASNPDVTGKVPYLKENGALGFRLGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK

C02276 609 MSRKRFSCDFETTTKLDDCRVWAYGYMEIGNLDNYKIGNSLDEFMQWAMEIQADLYFHDLK
FDGAFIVNWLFKNGFKWCKEAKEERTFSTIISRMGQWYMIDICIGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDVNSMYPAMMKNKLLPYGEPVMFKGEYKKNVEYPLYIQQVRCFFELKKDKIPCIQIKGN
ARFGQNEYLSTSGDEYVDLYVTNVDWELIKKHYDIFEEEFIGGFMFKGFIGFFDEYIDKRM
EIKNSPDSSAEQSLQAKLMLNSLYGKFASNPDVTGKVPYLKENGALGFRLGEEETKDPVYT
PLASFVTAWGRYTTITTAQACYDRIIYCDTDSIHLTGTKIPDVIKDIVHPKKLGYWEHEST
FKRAKYLRQKTYIQDIYMKRVKGYLVQGSPDDYTDIKFSVKCAGMTDKIKEEVTFENFKVG
FSRKMKPKPVQVPGGVVLVDSVFTIK

C02286 610 MSRKRFSCDFETTTKLDDCRVWAYGYMEIGNLDNYKIGNSLDEFMQWAMEIQADLYFHDLK
FDGAFIVNWLFKNGFKWCKEAKEERTFSTIISRMGQWYMIDICIGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDANSHYPAQMYVRPLPYGTPLFYQGEYKENIDHPLYIQNLKVRFRLKERHIPCIQVKRS
RLFIQNEYLESSVNELIELTLTNVDLDLFFEHYEILEIHYTYGYMFRASCDMFKDFIDKWT
YIKTTSYGAIKQLAKLMLNSLYGKFASNPDVTGKVPYLKENGALGFRLGEEETKDPVYTPL
ASFVTAWGRYTTITTAQACYDRIIYCDTDSIHLTGTKIPDVIKDIVHPKKLGYWEHESTFK
RAKYLRQKTYIQDIYMKRVKGYLVQGSPDDYTDIKFSVKCAGMTDKIKEEVTFENFKVGFS
RKMKPKPVQVPGGVVLVDSVFTIK

C02296 611 MSRKRFSCDFETTTKLDDCRVWAYGYMEIGNLDNYKIGNSLDEFMQWAMEIQADLYFHDLK
FDGAFIVNWLFKNGFKWCKEAKEERTFSTIISRMGQWYMIDICIGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDANSHYPAQMYVRPLPYGTPLFYQGEYKENIDHPLYIQNLKVRFRLKERHIPCIQVKRS
RLFKQNEYLESSVNELIELTLTNVDLDLFFEHYEILEIHYTYGYMFRASCDMFKDFIDKWT
YIKTTSYGAIKQLAKLMLNSLYGKFASNPDVTGKVPYLKENGALGFRLGEEETKDPVYTPL
ASFVTAWGRYTTITTAQACYDRIIYCDTDSIHLTGTKIPDVIKDIVHPKKLGYWEHESTFK
RAKYLRQKTYIQDIYMKRVKGYLVQGSPDDYTDIKFSVKCAGMTDKIKEEVTFENFKVGFS
RKMKPKPVQVPGGVVLVDSVFTIK

C02306 612 MSRKRFSCDFETTTKLDDCRVWAYGYMEIGNLDNYKIGNSLDEFMQWAMEIQADLYFHDLK
FDGAFIVNWLFKNGFKWCKEAKEERTFSTIISRMGQWYMIDICIGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDANSHYPAQMYVRPLPYGTPLFYQGEYKENIDHPLYIQNLKVRFRLKERHIPCIQVKRS
RLYKQNEYLESSVNELIELTLTNVDLDLFFEHYEILEIHYTYGYMFRASCDMFKDFIDKWT
YIKTTSYGAIKQLAKLMLNSLYGKFASNPDVTGKVPYLKENGALGFRLGEEETKDPVYTPL
ASFVTAWGRYTTITTAQACYDRIIYCDTDSIHLTGTKIPDVIKDIVHPKKLGYWEHESTFK
RAKYLRQKTYIQDIYMKRVKGYLVQGSPDDYTDIKFSVKCAGMTDKIKEEVTFENFKVGFS
RKMKPKPVQVPGGVVLVDSVFTIK

C02316 613 MSRKRFSCDFETTTKLDDCRVWAYGYMEIGNLDNYKIGNSLDEFMQWAMEIQADLYFHDLK
FDGAFIVNWLFKNGFKWCKEAKEERTFSTIISRMGQWYMIDICIGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM

TABLE 4-continued

Chimeric Polymerase Variants

| Name | SEQ ID NO | Sequence |
|---|---|---|
| | | VFDANSHYPAQMYVRPLPYGTPLFYQGEYKENIDHPLYIQNLKVRFRLKERHIPCIQVKRS<br>RFYKGNEYLESSVNELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C0232 | 614 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICIGYKGRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKRS<br>RLFKQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0233 | 615 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICIGYKGRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKEGYIPTIQIKRS<br>RFYKGNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0234 | 616 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICIGYKGRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKEGYIPTIQIKRS<br>RFYKGNEYLKSSGGELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C0235 | 617 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICIGYKGRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKEGYIPTIQIKRS<br>RFYKGNEYLKSSGGELIELTLTNVDLELMKEHYEILEIHYTYGYMFRASCDMFKDFIDKWT<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C0236 | 618 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0237 | 619 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP |

TABLE 4-continued

Chimeric Polymerase Variants

| Name | SEQ ID NO | Sequence |
|---|---|---|
| | | VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02386 | 20 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02396 | 21 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02406 | 22 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKEGYIPTIQIKRS<br>RFYKGNEYLESSVNKLGVDELIELTLTNVDLDLFFEHYEILEIHYTYGMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02416 | 23 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKEGYIPTIQIKRS<br>RFYKGNEYLKSSGGELIELTLTNVDLDLFFEHYEILEIHYTYGMFRASCDMFKDFIDKWF<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02426 | 24 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKEGYIPTIQIKRS<br>RFYKGNEYLKSSGGELIELTLTNVDLELMKEHYEILEIHYTYGMFRASCDMFKDFIDKWF<br>YIKTTSYGAIKQLAKLMLNSLYGKFASNPDVTGKVPYLKENGALGFRLGEEETKDPVYTPL<br>ASFVTAWGRYTTITTAQACYDRIIYCDTDSIHLTGTKIPDVIKDIVHPKKLGYWEHESTFK<br>RAKYLRQKTYIQDIYMKRVKGYLVQGSPDDYTDIKFSVKCAGMTDKIKEEVTFENFKVGFS<br>RKMKPKPVQVPGGVVLVDSVFTIK |
| C02436 | 25 | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDIIKDLVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02446 | 26 | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM |

TABLE 4-continued

Chimeric Polymerase Variants

| Name | SEQ ID NO | Sequence |
|---|---|---|
| | | VFDANSHYPAQMYVRPLPYGTPLFYQGEYKENIDHPLYIQNLKVRFRLKERHIPCIQVKQN SLFIQNEYLESSVNKLGVDELIELTLTNVDLDLFFEHYEILEIHYTYGYMFRASCDMFKDF IDKWFYIKTTSYGAIKQLAKLMLNSLYGKFASNPDVTGKVPYLKENGALGFRLGEEETKDP VYTPLASFVTAWGRYTTITTAQACYDRIIYCDTDSIHLTGTKVPDAIKDLVHPKKLGYWEH ESTFKRAKYLRQKTYIQDIYMKRVKGYLVQGSPDDYTDIKFSVKCAGMTDKIKEEVTFENF KVGFSRKMKPKPVQVPGGVVLVDSVFTIK |
| C02456 | 27 | MSRKRFSCDFETTTKLDDCRVWAYGYMEIGNLDNYKIGNSLDEFMQWAMEIQADLYFHNLK FDGAFIVNWLFKNGFKWCKEAKEERTFSTIISRMGQWYMIDICIGYKGRKIHTVIYDSLK KLPFPVEKIAKDFKLTVKKGDIDIHKERPVGYKITPEEYAYIKNDIQIIAEALLIQFKQGL DRMTAGSDSLKDFKDIITTKKFKKVFPTLSLGLDKEVRKAYRGGFTWLNDRFKGKEIGEGM VFDANSHYPAQMYVRPLPYGTPLFYQGEYKENIDHPLYIQNLKVRFRLKERHIPCIQVKQN SLFIQNEYLESSVNKLGVDELIELTLTNVDLDLFFEHYEILEIHYTYGYMFRASCDMFKDF IDKWFYIKTTSYGAIKQLAKLMLNSLYGKFASNPDVTGKVPYLKENGALGFRLGEEETKDP VYTPLASFVTAWGRYTTITTAQACYDRIIYCDTDSIHLTGTKVPDAIKDLVHPKKLGYWEH ESTFKRAKYLRQKTYVQDIYMKRVKGYLVQGSPDDYTDIKFSVKCAGMTDKIKEEVTFENF KVGFSRKMKPKPVQVPGGVVLVDSVFTIK |
| C02466 | 28 | MSRKRFSCDFETTTKLDDCRVWAYGYMEIGNLDNYKIGNSLDEFMQWAMEIQADLYFHNLK FDGAFIVNWLFKNGFKWCKEAKEERTFSTIISRMGQWYMIDICIGYKGRKIHTVIYDSLK KLPFPVEKIAKDFKLTVKKGDIDIHKERPVGYKITPEEYAYIKNDIQIIAEALLIQFKQGL DRMTAGSDSLKDFKDIITTKKFKKVFPTLSLGLDKEVRKAYRGGFTWLNDRFKGKEIGEGM VFDANSHYPAQMYVRPLPYGTPLFYQGEYKENIDHPLYIQNLKVRFRLKERHIPCIQVKQN SLFIQNEYLESSVNKLGVDELIELTLTNVDLDLFFEHYEILEIHYTYGYMFRASCDMFKDF IDKWFYIKTTSYGAIKQLAKLMLNSLYGKFASNPDVTGKVPYLKENGALGFRLGEEETKDP VYTPLASFVTAWGRYTTITTAQACYDRIIYCDTDSIHLTGTKVPDIIKDIVHPKKLGYWEH ESTFKRAKYLRQKTYIQDIYMKRVKGYLVQGSPDDYTDTKFSVKCAGMTDKIKEEVTFENF KVGFSRKMKPKPVQVPGGVVLVDSVFTIK |
| C02476 | 29 | MSRKRFSCDFETTTKLDDCRVWAYGYMEIGNLDNYKIGNSLDEFMQWAMEIQADLYFHDLK FDGAFIINWLFKNGFKWCKEAKEERTFSTIISRMGQWYMIDICLGYKGRKIHTVIYDSLK KLPFPVEKIAKDFKLTVKKGDIDIHKERPVGYKITPEEYAYIKNDIQIIAEALLIQFKQGL DRMTAGSDSLKDFKDIITTKKFKKVFPTLSLGLDKEVRKAYRGGFTWLNDRFKGKEIGEGM VFDANSHYPAQMYVKNKLLPYGEPVMFKGEYKKNVEYPLYIQQVRCFFELKKDKIPCIQIK GNARFGQNEYLSTSGDEYVDLYVTNVDWELIKKHYDIFEEEFIGGFMFKGMFKDFIDKWFY IKTTSYGAIKQLAKLMLNSLYGKFASNPDVTGKVPYLKENGALGFRLGEEETKDPVYTPLA SFVTAWGRYTTITTAQACYDRIIYCDTDSIHLTGTKIPDVIKDIVHPKKLGYWEHESTFKR AKYLRQKTYIQDIYMKRVKGYLVQGSPDDYTDIKFSVKCAGMTDKIKEEVTFENFKVGFSR KMKPKPVQVPGGVVLVDSVFTIK |
| C02486 | 30 | MKHMPRKMYSCDFETTTKVEDCRVWAYGYMNIEDHSEYKIGNSLDEFMAWVLKVQADLYFH NLKFDGAFIINWLFKNGFKWCKEAKEERTFSTIISRMGQWYMIDICLGYKGRKIHTVIYD SLKKLPFPVEKIAKDFKLTVKKGDIDIHKERPVGYKITPEEYAYIKNDIQIIAEALLIQFK QGLDRMTAGSDSLKDFKDIITTKKFKKVFPTLSLGLDKEVRKAYRGGFTWLNDRFKGKEIG EGMVFDANSHYPAQMYSRLLPYGEPIVFEGKYVWDEDYPLHIQHIRCEFELKEGYIPTIQI KRSRFYKGNEYLKSSGGEIADLWLSNVDLELMKEHYDLYNVEYISGLKFKATTGLFKDFID KWTYIKTTSYGAIKQLAKLMLNSLYGKFASNPDVTGKVPYLKENGALGFRLGEEETKDPVY TPLASFVTAWGRYTTITTAQACYDRIIYCDTDSIHLTGTKIPDVIKDIVHPKKLGYWEHES TFKRAKYLRQKTYIQDIYMKRVKGYLVQGSPDDYTDIKFSVKCAGMTDKIKEEVTFENFKV GFSRKMKPKPVQVPGGVVLVDSVFTIK |
| C02496 | 31 | MKHMPRKMYSCDFETTTKVEDCRVWAYGYMNIEDHSEYKIGNSLDEFMAWVLKVQADLYFH NLKFDGAFINWLERNGFKWSADGLPNTYNTIISRMGQWYMIDICLGYKGRKIHTVIYDS LKKLPFPVKKIAQDFKLTVKKGDIDYHKERPVGYKITPEEYAYIKNDIQIIAEALLIQFKQ GLDRMTAGSDSLKGFKDIITTKKFKKVFPTLSLGLDKEVRKAYRGGFTWLNDRFKGKEIGE GMVFDINSAYPAQMYVRPLPYGTPLFYEGEYKENIDYPLYIQNIKVRFRLKERHIPTIQVK QSSLFIQNEYLESSVNKLGVDELIDLTLTNVDLDLFFEHYDILEIHYTYGYMFKASCDMFK DFIDKWTYIKTTSYGAIKQLAKLMLNSLYGKFASNPDVTGKVPYLKENGALGFRLGEEETK DPVYTPMGVFITAWGRYTTITAAQACYDRIIYCDTDSIHLTGTKIPDVIKDIVHPKKLGYW EHESTFKRAKYLRQKTYIQDIYMKRVRGYLVQGSPDDYTDIKFSVKCAGMTDKIKEEVTFE NFKVGFSRKMKPKPVQVPGGVVLVDSVFTIK |
| C02506 | 32 | MKHMPRKMYSCDFETTTKVEDCRVWAYGYMNIEDHSEYKIGNSLDEFMAWVLKVQADLYFH NLKFDGAFINWLERNGFKWSADGLPNTYNTIISRMGQWYMIDICLGYKGRKIHTVIYDS LKKLPFPVKKIAQDFKLTVKKGDIDYHKERPVGYKITPEEYAYIKNDIQIIAEALLIQFKQ GLDRMTAGSDSLKGFKDIITTKKFKKVFPTLSLGLDKEVRKAYRGGFTWLNDRFKGKEIGE GMVFDINSAYPAQMYSRLLPYGEPIVFEGKYVWDEDHPLHIQHLRCEFELKEGYIPCIQIK QSLFYKGNEYLKSSGGEIAELWLSNVDLELMKEHYELYNVEYISGLKFRATTGLFKDFIDK |

TABLE 4-continued

Chimeric Polymerase Variants

| Name | SEQ ID NO | Sequence |
|---|---|---|
| | | WTYIKTTSYGAIKQLAKLMLNSLYGKFASNPDVTGKVPYLKENGALGFRLGEEETKDPVYT PMGVFITAWGRYTTITAAQACYDRIIYCDTDSIHLTGTKIPDVIKDIVHPKKLGYWEHEST FKRAKYLRQKTYIQDIYMKRVRGYLVQGSPDDYTDIKFSVKCAGMTDKIKEEVTFENFKVG FSRKMKPKPVQVPGGVVLVDSVFTIK |
| C02516 | 33 | MKHMPRKMYSCDFETTTKVEDCRVWAYGYMNIEDHSEYKIGNSLDEFMAWVLKVQADLYFH NLKFDGAFIINWLERNGFKWSADGLPNTYNTIISRMGQWYMIDICLGYKGKRKIHTVIYDS LKKLPFPVKKIAQDFKLTVKKGDIDYHKERPVGYKITPEEYAYIKNDIQIIAEALLIQFKQ GLDRMTAGSDSLKGFKDIITTKKFKKVFPTLSLGLDKEVRKAYRGGFTWLNDRFKGKEIGE GMVFDINSAYPAQMYVRPLPYGTPLFYEGEYKENIDHPLYIQNLKVRFRLKERHIPCIQVK QSSLFIQNEYLESSVNKLGVDELIELTLTNVDLDLFFEHYEILEIHYTYGYMFRASCDMFK DFIDKWTYIKTTSYGAIKQLAKLMLNSLYGKFASNPDVTGKVPYLKENGALGFRLGEEETK DPVYTPMGVFITAWGRYTTITAAQACYDRIIYCDTDSIHLTGTKIPDVIKDIVHPKKLGYW EHESTFKRAKYLRQKTYIQDIYMKRVRGYLVQGSPDDYTDIKFSVKCAGMTDKIKEEVTFE NFKVGFSRKMKPKPVQVPGGVVLVDSVFTIK |
| C02526 | 34 | MSRKMFSCDFETTTKLDDCRVWAYGYMEIGNLDNYKIGNSLDEFMQWVMEIQADLYFHNLK FDGAFIINWLERNGFKWSADGLPNTYNTIISRMGQWYMIDICLGYKGKRKIHTVIYDSLKK LPFPVKKIAQDFKLTVKKGDIDYHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMV FDINSAYPAQMYSRLLPYGEPIVFEGKYVWDEDYPLHIQHIRCEFELKEGYIPTIQIKQSL FYKGNEYLKSSGGEIADLWLSNVDLELMKEHYDLYNVEYISGLKFKATTGLFKDFIDKWTY IKTTSYGAIKQLAKLMLNSLYGKFASNPDVTGKVPYLKENGALGFRLGEEETKDPVYTPMG VFITAWGRYTTITAAQACYDRIIYCDTDSIHLTGTKIPDVIKDIVHPKKLGYWEHESTFKR AKYLRQKTYIQDIYMKRVRGYLVQGSPDDYTDIKFSVKCAGMTDKIKEEVTFENFKVGFSR KMKPKPVQVPGGVVLVDSVFTIK |
| C02536 | 35 | MKHMPRKMYSCDFETTTKVEDCRVWAYGYMNIEDHSEYKIGNSLDEFMAWVLKVQADLYFH NLKFDGAFIINWLFKNGFKWCKEAKEERTFSTIISRMGQWYMIDICLGYKGKRKIHTVIYD SLKKLPFPVKKIAQDFKLTVKKGDIDYHKERPVGYKITPEEYAYIKNDIQIIAEALLIQFK QGLDRMTAGSDSLKGFKDIITTKKFKKVFPTLSLGLDKEVRKAYRGGFTWLNDRFKGKEIG EGMVFDINSAYPAQMYSRLLPYGEPIVFEGKYVWDEDYPLHIQHIRCEFELKEGYIPTIQI KQSLFYKGNEYLKSSGGEIADLWLSNVDLELMKEHYDLYNVEYISGLKFKATTGLFKDFID KWTYIKTTSYGAIKQLAKLMLNSLYGKFASNPDVTGKVPYLKENGALGFRLGEEETKDPVY TPMGVFITAWGRYTTITAAQACYDRIIYCDTDSIHLTGTKIPDVIKDIVHPKKLGYWEHES TFKRAKYLRQKTYIQDIYMKRVRGYLVQGSPDDYTDIKFSVKCAGMTDKIKEEVTFENFKV GFSRKMKPKPVQVPGGVVLVDSVFTIK |
| C02546 | 36 | MKHMPRKMYSCDFETTTKVEDCRVWAYGYMNIEDHSEYKIGNSLDEFMAWVLKVQADLYFH NLKFDGAFIVNWLEKNGFKWSAEGLPNTYNTIISRMGQWYMIDICLGYKGKRKIHTVIYDS LKKLPFPVKKIAQDFKLTVKKGDIDYHKERPVGYKITPEEYAYIKNDIQIIAEALLIQFKQ GLDRMTAGSDSLKGFKDIITTKKFKKVFPTLSLGLDKEVRKAYRGGFTWLNDRFKGKEIGE GMVFDINSAYPAQMYSRLLPYGEPIVFEGKYVWDEDYPLHIQHIRCEFELKEGYIPTIQIK QSLFYKGNEYLKSSGGEIADLWLSNVDLELMKEHYDLYNVEYISGLKFKATTGLFKDFIDK WTYIKTTSYGAIKQLAKLMLNSLYGKFASNPDVTGKVPYLKENGALGFRLGEEETKDPVYT PMGVFITAWGRYTTITAAQACYDRIIYCDTDSIHLTGTKIPDVIKDIVHPKKLGYWEHEST FKRAKYLRQKTYIQDIYMKRVRGYLVQGSPDDYTDIKFSVKCAGMTDKIKEEVTFENFKVG FSRKMKPKPVQVPGGVVLVDSVFTIK |
| C02556 | 37 | MSRKMFSCDFETTTKLDDCRVWAYGYMEIGNLDNYKIGNSLDEFMQWVMEIQADLYFHNLK FDGAFIVNWLEKNGFKWSAEGLPNTYNTIISRMGQWYMIDICLGYKGKRKIHTVIYDSLKK LPFPVKKIAQDFKLTVKKGDIDYHKERPVGYKITPEEYAYIKNDIQIIAEALLIQFKQGLD RMTAGSDSLKGFKDIITTKKFKKVFPTLSLGLDKEVRKAYRGGFTWLNDRFKGKEIGEGMV FDINSAYPAQMYSRLLPYGEPIVFEGKYVWDEDYPLHIQHIRCEFELKEGYIPTIQIKQSL FYKGNEYLKSSGGEIADLWLSNVDLELMKEHYDLYNVEYISGLKFKATTGLFKDFIDKWTY IKTTSYGAIKQLAKLMLNSLYGKFASNPDVTGKVPYLKENGALGFRLGEEETKDPVYTPMG VFITAWGRYTTITAAQACYDRIIYCDTDSIHLTGTKIPDVIKDIVHPKKLGYWEHESTFKR AKYLRQKTYIQDIYMKRVRGYLVQGSPDDYTDIKFSVKCAGMTDKIKEEVTFENFKVGFSR KMKPKPVQVPGGVVLVDSVFTIK |
| C02566 | 38 | MSRKMFSCDFETTTKLDDCRVWAYGYMEIGNLDNYKIGNSLDEFMQWVMEIQADLYFHNLK FDGAFIINWLFKNGFKWCKEAKEERTFSTIISRMGQWYMIDICLGYKGKRKIHTVIYDSLK KLPFPVKKIAQDFKLTVKKGDIDYHKERPVGYKITPEEYAYIKNDIQIIAEALLIQFKQGL DRMTAGSDSLKGFKDIITTKKFKKVFPTLSLGLDKEVRKAYRGGFTWLNDRFKGKEIGEGM VFDINSAYPAQMYSRLLPYGEPIVFEGKYVWDEDYPLHIQHIRCEFELKEGYIPTIQIKQS LFYKGNEYLKSSGGEIADLWLSNVDLELMKEHYDLYNVEYISGLKFKATTGLFKDFIDKWT YIKTTSYGAIKQLAKLMLNSLYGKFASNPDVTGKVPYLKENGALGFRLGEEETKDPVYTPM GVFITAWGRYTTITAAQACYDRIIYCDTDSIHLTGTKIPDVIKDIVHPKKLGYWEHESTFK RAKYLRQKTYIQDIYMKRVRGYLVQGSPDDYTDIKFSVKCAGMTDKIKEEVTFENFKVGFS RKMKPKPVQVPGGVVLVDSVFTIK |
| C02576 | 39 | MKHMPRKMYSCDFETTTKVEDCRVWAYGYMNIEDHSEYKIGNSLDEFMAWVLKVQADLYFH NLKFDGAFIINWLERNGFKWSADGLPNTYNTIISRMGQWYMIDICLGYKGKRKIHTVIYDS LKKLPFPVKKIAQDFKLTVKKGDIDYHKERPVGYKITPEEYAYIKNDIQIIAEALLIQFKQ |

TABLE 4-continued

Chimeric Polymerase Variants

| Name | SEQ ID NO | Sequence |
|---|---|---|
| | | GLDRMTAGSDSLKGFKDIITTKKFKKVFPTLSLGLDKEVRKAYRGGFTWLNDRFKGKEIGE
GMVFDINSAYPAQMYSRLLPYGEPIVFEGKYVWDEDYPLHIQHIRCEFELKEGYIPTIQIK
QSLFYKGNEYLKSSGGEIADLWLSNVDLELMKEHYDLYNVEYISGLKFKATTGLFKDFIDK
WTYIKTTSYGAIKQLAKLMLNSLYGKFASNPDVTGKVPYLKENGALGFRLGEEETKDPVYT
PLASFVTAWGRYTTITTAQACYDRIIYCDTDSIHLTGTKIPDVIKDIVHPKKLGYWEHEST
FKRAKYLRQKTYIQDIYMKRVRGYLVQGSPDDYTDIKFSVKCAGMTDKIKEEVTFENFKVG
FSRKMKPKPVQVPGGVVLVDSVFTIK |
| C02586 | 40 | MKHMPRKMYSCDFETTTKVEDCRVWAYGYMNIEDHSEYKIGNSLDEFMAWVLKVQADLYFH
NLKFDGAFIINWLERNGFKWSADGLPNTYNTIISRMGQWYMIDICLGYKGKRKIHTVIYDS
LKKLPFPVKKIAQDFKLTVKKGDIDYHKERPVGYKITPEEYAYIKNDIQIIAEALLIQFKQ
GLDRMTAGSDSLKDFKDIITTKKFKKVFPTLSLGLDKEVRKAYRGGFTWLNDRFKGKEIGE
GMVFDINSAYPAQMYSRLLPYGEPIVFEGKYVWDEDYPLHIQHIRCEFELKEGYIPTIQIK
QSLFYKGNEYLKSSGGEIADLWLSNVDLELMKEHYDLYNVEYISGLKFKATTGLFKDFIDK
WTYIKTTSYGAIKQLAKLMLNSLYGKFASNPDVTGKVPYLKENGALGFRLGEEETKDPVYT
PMGVFITAWGRYTTITAAQACYDRIIYCDTDSIHLTGTKVPDAIKDLVHPKKLGYWEHEST
FKRAKYLRQKTYVQDIYMKRVRGYLVQGSPDDYTDIKFSVKCAGMTDKIKEEVTFENFKVG
FSRKMKPKPVQVPGGVVLVDSVFTIK |
| C02596 | 41 | MKHMPRKMYSCDFETTTKVEDCRVWAYGYMNIEDHSEYKIGNSLDEFMAWVLKVQADLYFH
NLKFDGAFIINWLERNGFKWSADGLPNTYNTIISRMGQWYMIDICLGYKGKRKIHTVIYDS
LKKLPFPVKKIAQDFKLTVKKGDIDYHKERPVGYKITPEEYAYIKNDIQIIAEALLIQFKQ
GLDRMTAGSDSLKDFKDIITTKKFKKVFPTLSLGLDKEVRKAYRGGFTWLNDRFKGKEIGE
GMVFDINSAYPAQMYSRLLPYGEPIVFEGKYVWDEDYPLHIQHIRCEFELKEGYIPTIQIK
QSLFYKGNEYLKSSGGEIADLWLSNVDLELMKEHYDLYNVEYISGLKFKATTGLFKDFIDK
WTYIKTTSYGAIKQLAKLMLNSLYGKFASNPDVTGKVPYLKENGALGFRLGEEETKDPVYT
PLASFVTAWGRYTTITTAQACYDRIIYCDTDSIHLTGTKVPDAIKDLVHPKKLGYWEHEST
FKRAKYLRQKTYVQDIYMKRVRGYLVQGSPDDYTDIKFSVKCAGMTDKIKEEVTFENFKVG
FSRKMKPKPVQVPGGVVLVDSVFTIK |
| C02606 | 42 | MKHMPRKRYSCDFETTTKVEDCRVWAYGYMNIEDHSEYKIGNSLDEFMAWALKVQADLYFH
NLKFDGAFIINWLERNGFKWSADGLPNTYNTIISRMGQWYMIDICLGYKGKRKIHTVIYDS
LKKLPFPVKKIAQDFKLTVKKGDIDYHKERPVGYKITPEEYAYIKNDIQIIAEALLIQFKQ
GLDRMTAGSDSLKDFKDIITTKKFKKVFPTLSLGLDKEVRKAYRGGFTWLNDRFKGKEIGE
GMVFDINSAYPAQMYSRLLPYGEPIVFEGKYVWDEDYPLHIQHIRCEFELKEGYIPTIQIK
QSLFYKGNEYLKSSGGEIADLWLSNVDLELMKEHYDLYNVEYISGLKFKATTGLFKDFIDK
WTYIKTTSYGAIKQLAKLMLNSLYGKFASNPDVTGKVPYLKENGALGFRLGEEETKDPVYT
PMGVFITAWGRYTTITAAQACYDRIIYCDTDSIHLTGTKIPDVIKDIVHPKKLGYWEHEST
FKRAKYLRQKTYIQDIYMKRVRGYLVQGSPDDYTDIKFSVKCAGMTDKIKEEVTFENFKVG
FSRKMKPKPVQVPGGVVLVDSVFTIK |
| C02616 | 43 | MSRKMFSCDFETTTKLDDCRVWAYGYMEIGNLDNYKIGNSLDEFMQWVMEIQADLYFHNLK
FDGAFIINWLERNGFKWSADGLPNTYNTIISRMGQWYMIDICLGYKGKRKIHTVIYDSLKK
LPFPVKKIAQDFKLTVKKGDIDYHKERPVGYKITPEEYAYIKNDIQIIAEALLIQFKQGLD
RMTAGSDSLKGFKDIITTKKFKKVFPTLSLGLDKEVRKAYRGGFTWLNDRFKGKEIGEGMV
FDINSAYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTGYMFKASCDMFKDFI
DKWTYIKTTSYGAIKQLAKLMLNSLYGKFASNPDVTGKVPYLKENGALGFRLGEEETKDPV
YTPMGVFITAWGRYTTITAAQACYDRIIYCDTDSIHLTGTKIPDVIKDIVHPKKLGYWEHE
STFKRAKYLRQKTYIQDIYMKRVRGYLVQGSPDDYTDIKFSVKCAGMTDKIKEEVTFENFK
VGFSRKMKPKPVQVPGGVVLVDSVFTIK |
| C02626 | 44 | MKHMPRKRYSCDFETTTKVEDCRVWAYGYMNIEDHSEYKIGNSLDEFMAWALKVQADLYFH
NLKFDGAFIINWLERNGFKWSADGLPNTYNTIISRMGQWYMIDICLGYKGKRKIHTVIYDS
LKKLPFPVKKIAQDFKLTVKKGDIDYHKERPVGYKITPEEYAYIKNDIQIIAEALLIQFKQ
GLDRMTAGSDSLKDFKDIITTKKFKKVFPTLSLGLDKEVRKAYRGGFTWLNDRFKGKEIGE
GMVFDINSAYPAQMYVRPLPYGTPLFYEGEYKENIDYPLYIQNIKVRFRLKERHIPTIQVK
QSSLFIQNEYLESSVNKLGVDELIDLTLTNVDLDLFFEHYDILEIHYTGYMFKASCDMFK
DFIDKWTYIKTTSYGAIKQLAKLMLNSLYGKFASNPDVTGKVPYLKENGALGFRLGEEETK
DPVYTPMGVFITAWGRYTTITAAQACYDRIIYCDTDSIHLTGTKIPDVIKDIVHPKKLGYW
EHESTFKRAKYLRQKTYIQDIYMKRVRGYLVQGSPDDYTDIKFSVKCAGMTDKIKEEVTFE
NFKVGFSRKMKPKPVQVPGGVVLVDSVFTIK |
| C02636 | 45 | MSRKRFSCDFETTTKLDDCRVWAYGYMEIGNLDNYKIGNSLDEFMQWAMEIQADLYFHNLK
FDGAFIINWLERNGFKWSADGLPNTYNTIISRMGQWYMIDICLGYKGKRKIHTVIYDSLKK
LPFPVKKIAQDFKLTVKKGDIDYHKERPVGYKITPEEYAYIKNDIQIIAEALLIQFKQGLD
RMTAGSDSLKDFKDIITTKKFKKVFPTLSLGLDKEVRKAYRGGFTWLNDRFKGKEIGEGMV
FDINSAYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTGYMFKASCDMFKDFI
DKWTYIKTTSYGAIKQLAKLMLNSLYGKFASNPDVTGKVPYLKENGALGFRLGEEETKDPV
YTPMGVFITAWGRYTTITAAQACYDRIIYCDTDSIHLTGTKIPDVIKDIVHPKKLGYWEHE
STFKRAKYLRQKTYIQDIYMKRVRGYLVQGSPDDYTDIKFSVKCAGMTDKIKEEVTFENFK
VGFSRKMKPKPVQVPGGVVLVDSVFTIK |

TABLE 4-continued

Chimeric Polymerase Variants

| Name | SEQ ID NO | Sequence |
|---|---|---|
| C0264 | 646 | MKHMPRKMYSCDFETTTKVEDCRVWAYGYMNIEDHSEYKIGNSLDEFMAWVLKVQADLYFH<br>NLKFDGAFIVNWLEKNGFKWSAEGLPNTYNTIISRMGQWYMIDICIGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKGFKDIITTKKFKKVFPTLSLGLDKEVRKAYRGGFTWLNDRFKGKEIGE<br>GMVFDINSAYPAQMYSRLLPYGEPIVFEGKYVWDEDHPLHIQHLRCEFELKEGYIPCIQIK<br>QSLFYKGNEYLKSSGGEIAELWLSNVDLELMKEHYELYNVEYISGLKFRATTGLFKDFIDK<br>WTYIKTTSYGAIKQLAKLMLNSLYGKFASNPDVTGKVPYLKENGALGFRLGEEETKDPVYT<br>PMGVFITAWGRYTTITAAQACYDRIIYCDTDSIHLTGTKVPDAIKDLVHPKKLGYWEHEST<br>FKRAKYLRQKTYVQDIYMKRVRGYLVQGSPDDYTDIKFSVKCAGMTDKIKEEVTFENFKVG<br>FSRKMKPKPVQVPGGVVLVDSVFTIK |
| C0265 | 647 | MKHMPRKRYSCDFETTTKVEDCRVWAYGYMNIEDHSEYKIGNSLDEFMAWALKVQADLYFH<br>NLKFDGAFIVNWLEKNGFKWSAEGLPNTYNTIISRMGQWYMIDICIGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYSRLLPYGEPIVFEGKYVWDEDHPLHIQHLRCEFELKEGYIPCIQIK<br>QSLFYKGNEYLKSSGGEIAELWLSNVDLELMKEHYELYNVEYISGLKFRATTGLFKDFIDK<br>WTYIKTTSYGAIKQLAKLMLNSLYGKFASNPDVTGKVPYLKENGALGFRLGEEETKDPVYT<br>PMGVFITAWGRYTTITAAQACYDRIIYCDTDSIHLTGTKVPDAIKDLVHPKKLGYWEHEST<br>FKRAKYLRQKTYVQDIYMKRVRGYLVQGSPDDYTDIKFSVKCAGMTDKIKEEVTFENFKVG<br>FSRKMKPKPVQVPGGVVLVDSVFTIK |
| C0266 | 648 | MKHMPRKRYSCDFETTTKVEDCRVWAYGYMNIEDHSEYKIGNSLDEFMAWALKVQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPLASFVTAWGRYTTITTAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0267 | 649 | MSRKRFSCDFETTTKLDDCRVWAYGYMEIGNLDNYKIGNSLDEFMQWAMEIQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKEEVTFENFK<br>VGFSRKMKPKPVQVPGGVVLVDSVFTIK |
| C0268 | 650 | MKHMPRKRYSCDFETTTKVEDCRVWAYGYMNIEDHSEYKIGNSLDEFMAWALKVQADLYFH<br>NLKFDGAFIVNWLEKNGFKWSAEGLPNTYNTIISRMGQWYMIDICIGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDHPLYIQNLKVRFRLKERHIPCIQVK<br>QSSLFIQNEYLESSVNKLGVDELIELTLTNVDLDLFFEHYEILEIHYTYGYMFRASCDMFK<br>DFIDKWTYIKTTSYGAIKQLAKLMLNSLYGKFASNPDVTGKVPYLKENGALGFRLGEEETK<br>DPVYTPLASFVTAWGRYTTITTAQACYDRIIYCDTDSIHLTGTKVPDAIKDLVHPKKLGYW<br>EHESTFKRAKYLRQKTYVQDIYMKRVRGYLVQGSPDDYTDIKFSVKCAGMTDKIKEEVTFE<br>NFKVGFSRKMKPKPVQVPGGVVLVDSVFTIK |
| C0269 | 651 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQN<br>SLFIQNEYLENSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0270 | 652 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH |

TABLE 4-continued

Chimeric Polymerase Variants

| Name | SEQ ID NO | Sequence |
|---|---|---|
| | | ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0271 | 653 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQS<br>SLFIQNEYLENSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0272 | 654 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQN<br>SLFIQNEYLENSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0273 | 655 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0274 | 656 | MSRKRFSCDFETTTKLDDCRVWAYGYMEIGNLDNYKIGNSLDEFMQWAMEIQADLYFHDLK<br>FDGAFIVNWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0275 | 657 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICVGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0276 | 658 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQN<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0277 | 659 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKQHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYVQNLKVRFRLKERHIPCIQVKQS |

TABLE 4-continued

Chimeric Polymerase Variants

| Name | SEQ ID NO | Sequence |
|---|---|---|
| | | SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0278 | 660 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIEITLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0279 | 661 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYVQNLKVRFRLKERHIPCIQVKQS<br>SLFIQNEYLESSVNKLGVDELIEITLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0280 | 662 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKQHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0281 | 663 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTVTNVDLDLFFEHYEILEIHYTYGYMFRGSCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0282 | 664 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTVTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0283 | 665 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRGSCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0284 | 666 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK |

TABLE 4-continued

Chimeric Polymerase Variants

| Name | SEQ ID NO | Sequence |
|---|---|---|
| | | KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTVTNVDLDLFFEHYEILEIHYTYGYMFRGSCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02856 | 67 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVDGYLVQGSPDDYTDIKFSVKCAGMTDKIKEEVTFENF<br>KVGFSRKMKPKPVQVPGGVVLVDSVFTIK |
| C02866 | 68 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKLSVKCAGMTDKIKEEVTFENF<br>KVGFSRKMKPKPVQVPGGVVLVDSVFTIK |
| C02876 | 69 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYQGEYKENIDHPLYVQNLKVRFRLKERHIPCIQVKQN<br>SLFIQNEYLENSVNKLGVDELIEITLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02886 | 70 | MSRKRFSCDFETTTKLDDCRVWAYGYMEIGNLDNYKIGNSLDEFMQWAMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWFYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTKIPDVIKDIVHPKKLGYWEHE<br>STFKRAKYLRQKTYIQDIYMKRVKGYLVQGSPDDYTDIKFSVKCAGMTDKIKEEVTFENFK<br>VGFSRKMKPKPVQVPGGVVLVDSVFTIK |
| C02896 | 71 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C02906 | 72 | MSRKRFSCDFETTTKLDDCRVWAYGYMEIGNLDNYKIGNSLDEFMQWAMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWFYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTKIPDVIKDIVHPKKLGYWEHE<br>STFKRAKYLRQKTYIQDIYMKRVKGYLVQGSPDDYTDIKFSVKCAGMTDKIKEEVTFENFK<br>VGFSRKMKPKPVQVPGGVVLVDSVFTIK |

TABLE 4-continued

Chimeric Polymerase Variants

| Name | SEQ ID NO | Sequence |
|---|---|---|
| C02916 | 73 | MSRKMFSCDFETTTKLDDCRVWAYGYMEIGNLDNYKIGNSLDEFMQWVMEIQADLYFHDLK<br>FDGAFIVNWLEKNGFKWSAEGLPNTYNTIISRMGQWYMIDICIGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C02926 | 74 | MSRKRFSCDFETTTKLDDCRVWAYGYMEIGNLDNYKIGNSLDEFMQWAMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C02936 | 75 | MSRKRFSCDFETTTKLDDCRVWAYGYMEIGNLDNYKIGNSLDEFMQWAMEIQADLYFHDLK<br>FDGAFIVNWLEKNGFKWSAEGLPNTYNTIISRMGQWYMIDICIGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C02946 | 76 | MSRKRFSCDFETTTKLDDCRVWAYGYMEIGNLDNYKIGNSLDEFMQWAMEIQADLYFHDLK<br>FDGAFIVNWLEKNGFKWSAEGLPNTYNTIISRMGQWYMIDICIGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C02956 | 77 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWFYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C02966 | 78 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWFYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C02976 | 79 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIDHPLYIQNLKVRFRLKERHIPTIQVKQNS<br>LFIQNEYLENSVNKLGVDELIDLTLTNVDLDLFFEHYEILEIHYTYGYMFRASCDMFKDFI<br>DKWFYIKTTSYGAIKQLAKLMLNSLYGKFASNPDVTGKVPYLKENGALGFRLGEEETKDPV |

TABLE 4-continued

Chimeric Polymerase Variants

| Name | SEQ ID NO | Sequence |
|---|---|---|
| | | YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C02986 | 80 | MSRKMFSCDFETTTKLDDCRVWAYGYMEIGNLDNYKIGNSLDEFMQWVMEIQADLYFHDLK<br>FDGAFIVNWLEKNGFKWSAEGLPNTYNTIISRMGQWYMIDICIGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWFYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C02996 | 81 | MSRKMFSCDFETTTKLDDCRVWAYGYMEIGNLDNYKIGNSLDEFMQWVMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWFYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C03006 | 82 | MSRKRFSCDFETTTKLDDCRVWAYGYMEIGNLDNYKIGNSLDEFMQWAMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWFYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C03016 | 83 | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDINSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C03026 | 84 | MSRKMFSCDFETTTKLDDCRVWAYGYMEIGNLDNYKIGNSLDEFMQWVMEIQADLYFHNLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C03036 | 85 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C03046 | 86 | MSRKRFSCDFETTTKLDDCRVWAYGYMEIGNLDNYKIGNSLDEFMQWAMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM |

TABLE 4-continued

Chimeric Polymerase Variants

| Name | SEQ ID NO | Sequence |
|---|---|---|
| | | VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTEIPDVIKDIVDPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDETFTIK |
| C0305687 | | MSRKMFSCDFETTTKLDDCRVWAYGYMEIGNLDNYKIGNSLDEFMQWVMEIQADLYFHDLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDSVFTIK |
| C0306688 | | MSRKRFSCDFETTTKLDDCRVWAYGYMEIGNLDNYKIGNSLDEFMQWAMEIQADLYFHDLK<br>FDGAFIINWLFRNGFKWCKDAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKKEVTFENF<br>KVGFSRKMKPKPVQVPGGVVLVDSVFTIK |
| C0307689 | | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYEGEYKENIDHPLYIQNLKVRFRLKERHIPCIQVKQSS<br>LFIQNEYLESSVNKLGVDELIELTLTNVDLDLFFEHYEILEIHYTYGYMFRASCDMFKDFI<br>DKWFYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0308690 | | MSRKMFSCDFETTTKLDDCRVWAYGYMEIGNLDNYKIGNSLDEFMQWVMEIQADLYFHDLK<br>FDGAFIINWLERNGFKWSADGLPNTYNTIISRMGQWYMIDICLGYKGKRKIHTVIYDSLKK<br>LPFPVEKIAKDFKLTVKKGDIDIHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDANSHYPAQMYVRPLPYGTPLFYQGEYKENIDHPLYIQNLKVRFRLKERHIPTIQVKQNS<br>LFIQNEYLENSVNKLGVDELIDLTLTNVDLDLFFEHYEILEIHYTYGYMFRASCDMFKDFI<br>DKWTYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTEIPDVIKDIVDPKKLGYWEHE<br>STFKRAKYLRQKTYIQDIYMKRVKGYLVQGSPDDYTDIKFSVKCAGMTDKIKKEVTFENFK<br>VGFSRKMKPKPVQVPGGVVLVDETFTIK |
| C0309691 | | MSRKMFSCDFETTTKLDDCRVWAYGYMEIGNLDNYKIGNSLDEFMQWVMEIQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPLASFVTAWGRYTTITTAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKKEVTFENFK<br>VGFSRKMKPKPVQVPGGVVLVDSVFTIK |
| C0310692 | | MSRKMFSCDFETTTKLDDCRVWAYGYMEIGNLDNYKIGNSLDEFMQWVMEIQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKGFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI |

TABLE 4-continued

Chimeric Polymerase Variants

| Name | SEQ ID NO | Sequence |
|---|---|---|
| | | DKWTYIKTTSYGAIKQLAKLMLNSLYGKFASNPDVTGKVPYLKENGALGFRLGEEETKDPV
YTPLASFVTAWGRYTTITTAQACYDRIIYCDTDSIHLTGTKIPDVIKDIVHPKKLGYWEHE
STFKRAKYLRQKTYIQDIYMKRVRGYLVQGSPDDYTDIKFSVKCAGMTDKIKEEVTFENFK
VGFSRKMKPKPVQVPGGVVLVDSVFTIK |
| C03116 | 93 | MKHMPRKRYSCDFETTTKVEDCRVWAYGYMNIEDHSEYKIGNSLDEFMAWALKVQADLYFH
NLKFDGAFIINWLFKNGFKWCKEAKEERTFSTIISRMGQWYMIDICLGYKGKRKIHTVIYD
SLKKLPFPVKKIAQDFKLTVKKGDIDYHKERPVGYKITPEEYAYIKNDIQIIAEALLIQFK
QGLDRMTAGSDSLKDFKDIITTKKFKKVFPTLSLGLDKEVRKAYRGGFTWLNDRFKGKEIG
EGMVFDINSAYPAQMYVRPLPYGTPLFYEGEYKENIDYPLYIQNIKVRFRLKERHIPTIQV
KQSSLFIQNEYLESSVNKLGVDELIDLTLTNVDLDLFFEHYDILEIHYTYGYMFKASCDMF
KDFIDKWTYIKTTSYGAIKQLAKLMLNSLYGKFASNPDVTGKVPYLKENGALGFRLGEEET
KDPVYTPLASFVTAWGRYTTITTAQACYDRIIYCDTDSIHLTGTKIPDVIKDIVHPKKLGY
WEHESTFKRAKYLRQKTYIQDIYMKRVRGYLVQGSPDDYTDIKFSVKCAGMTDKIKEEVTF
ENFKVGFSRKMKPKPVQVPGGVVLVDSVFTIK |
| C03126 | 94 | MKHMPRKRYSCDFETTTKVEDCRVWAYGYMNIEDHSEYKIGNSLDEFMAWALKVQADLYFH
NLKFDGAFIVNWLEKNGFKWSAEGLPNTYNTIISRMGQWYMIDICIGYKGKRKIHTVIYDS
LKKLPFPVKKIAQDFKLTVKKGDIDYHKERPVGYKITPEEYAYIKNDIQIIAEALLIQFKQ
GLDRMTAGSDSLKDFKDIITTKKFKKVFPTLSLGLDKEVRKAYRGGFTWLNDRFKGKEIGE
GMVFDINSAYPAQMYVRPLPYGTPLFYEGEYKENIDYPLYIQNIKVRFRLKERHIPTIQVK
QSSLFIQNEYLESSVNKLGVDELIDLTLTNVDLDLFFEHYDILEIHYTYGYMFKASCDMFK
DFIDKWTYIKTTSYGAIKQLAKLMLNSLYGKFASNPDVTGKVPYLKENGALGFRLGEEETK
DPVYTPLASFVTAWGRYTTITTAQACYDRIIYCDTDSIHLTGTKIPDVIKDIVHPKKLGYW
EHESTFKRAKYLRQKTYIQDIYMKRVRGYLVQGSPDDYTDIKFSVKCAGMTDKIKEEVTFE
NFKVGFSRKMKPKPVQVPGGVVLVDSVFTIK |
| C03136 | 95 | MKHMPRKRYSCDFETTTKVEDCRVWAYGYMNIEDHSEYKIGNSLDEFMAWALKVQADLYFH
NLKFDGAFIINWLERNGFKWSADGLPNTYNTIISRMGQWYMIDICLGYKGKRKIHTVIYDS
LKKLPFPVKKIAQDFKLTVKKGDIDYHKERPVGYKITPEEYAYIKNDIQIIAEALLIQFKQ
GLDRMTAGSDSLKDFKDIITTKKFKKVFPTLSLGLDKEVRKAYRGGFTWLNDRFKGKEIGE
GMVFDINSAYPAQMYVRPLPYGTPLFYEGEYKENIDYPLYIQNIKVRFRLKERHIPTIQVK
QSSLFIQNEYLESSVNKLGVDELIDLTLTNVDLDLFFEHYDILEIHYTYGYMFKASCDMFK
DFIDKWTYIKTTSYGAIKQLAKLMLNSLYGKFASNPDVTGKVPYLKENGALGFRLGEEETK
DPVYTPLASFVTAWGRYTTITTAQACYDRIIYCDTDSIHLTGTKVPDAIKDLVHPKKLGYW
EHESTFKRAKYLRQKTYVQDIYMKRVRGYLVQGSPDDYTDIKFSVKCAGMTDKIKEEVTFE
NFKVGFSRKMKPKPVQVPGGVVLVDSVFTIK |
| C03146 | 96 | MSRKMFSCDFETTTKLDDCRVWAYGYMEIGNLDNYKIGNSLDEFMQWVMEIQADLYFHNLK
FDGAFIINWLERNGFKWSADGLPNTYNTIISRMGQWYMIDICLGYKGKRKIHTVIYDSLKK
LPFPVKKIAQDFKLTVKKGDIDYHKERPVGYKITPEEYAYIKNDIQIIAEALLIQFKQGLD
RMTAGSDSLKDFKDIITTKKFKKVFPTLSLGLDKEVRKAYRGGFTWLNDRFKGKEIGEGMV
FDINSAYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YTPLASFVTAWGRYTTITTAQACYDRIIYCDTDSIHLTGTKVPDAIKDLVHPKKLGYWEHE
STFKRAKYLRQKTYVQDIYMKRVRGYLVQGSPDDYTDIKFSVKCAGMTDKIKEEVTFENFK
VGFSRKMKPKPVQVPGGVVLVDSVFTIK |
| C03156 | 97 | MSRKRFSCDFETTTKLDDCRVWAYGYMEIGNLDNYKIGNSLDEFMQWAMEIQADLYFHNLK
FDGAFIINWLERNGFKWSADGLPNTYNTIISRMGQWYMIDICLGYKGKRKIHTVIYDSLKK
LPFPVKKIAQDFKLTVKKGDIDYHKERPVGYKITPEEYAYIKNDIQIIAEALLIQFKQGLD
RMTAGSDSLKDFKDIITTKKFKKVFPTLSLGLDKEVRKAYRGGFTWLNDRFKGKEIGEGMV
FDINSAYPAQMYVRPLPYGTPLFYEGEYKENIDYPLYIQNIKVRFRLKERHIPTIQVKQSS
LFIQNEYLESSVNKLGVDELIDLTLTNVDLDLFFEHYDILEIHYTYGYMFKASCDMFKDFI
DKWTYIKTTSYGAIKQLAKLMLNSLYGKFASNPDVTGKVPYLKENGALGFRLGEEETKDPV
YTPLASFVTAWGRYTTITTAQACYDRIIYCDTDSIHLTGTKVPDAIKDLVHPKKLGYWEHE
STFKRAKYLRQKTYVQDIYMKRVRGYLVQGSPDDYTDIKFSVKCAGMTDKIKEEVTFENFK
VGFSRKMKPKPVQVPGGVVLVDSVFTIK |
| C03166 | 98 | MKHMPRKRYSCDFETTTKVEDCRVWAYGYMNIEDHSEYKIGNSLDEFMAWALKVQADLYFH
NLKFDGAFIINWLFKNGFKWCKEAKEERTFSTIISRMGQWYMIDICLGYKGKRKIHTVIYD
SLKKLPFPVKKIAQDFKLTVKKGDIDYHKERPVGYKITPEEYAYIKNDIQIIAEALLIQFK
QGLDRMTAGSDSLKDFKDIITTKKFKKVFPTLSLGLDKEVRKAYRGGFTWLNDRFKGKEIG
EGMVFDINSAYPAQMYVRPLPYGTPLFYEGEYKENIDYPLYIQNIKVRFRLKERHIPTIQV
KQSSLFIQNEYLESSVNKLGVDELIDLTLTNVDLDLFFEHYDILEIHYTYGYMFKASCDMF
KDFIDKWTYIKTTSYGAIKQLAKLMLNSLYGKFASNPDVTGKVPYLKENGALGFRLGEEET
KDPVYTPLASFVTAWGRYTTITTAQACYDRIIYCDTDSIHLTGTKVPDAIKDLVHPKKLGY
WEHESTFKRAKYLRQKTYVQDIYMKRVRGYLVQGSPDDYTDIKFSVKCAGMTDKIKEEVTF
ENFKVGFSRKMKPKPVQVPGGVVLVDSVFTIK |
| C03176 | 99 | MKHMPRKRYSCDFETTTKVEDCRVWAYGYMNIEDHSEYKIGNSLDEFMAWALKVQADLYFH
NLKFDGAFIVNWLEKNGFKWSAEGLPNTYNTIISRMGQWYMIDICIGYKGKRKIHTVIYDS
LKKLPFPVKKIAQDFKLTVKKGDIDYHKERPVGYKITPEEYAYIKNDIQIIAEALLIQFKQ |

TABLE 4-continued

Chimeric Polymerase Variants

| Name | SEQ ID NO | Sequence |
|---|---|---|
| | | GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPLASFVTAWGRYTTITTAQACYDRIIYCDTDSIHLTGTKVPDAIKDLVHPKKLGYW<br>EHESTFKRAKYLRQKTYVQDIYMKRVRGYLVQGSPDDYTDIKFSVKCAGMTDKIKEEVTFE<br>NFKVGFSRKMKPKPVQVPGGVVLVDSVFTIK |
| C0318700 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKVPDAIKDLVHPKKLGYWEH<br>ESTFKRAKYLRQKTYVQDIYMKRVRGYLVQGSPDDYTDIKFSVKCAGMTDKIKEEVTFENF<br>KVGFSRKMKPKPVQVPGGVVLVDSVFTIK |
| C0319701 | | MKHMPRKRYSCDFETTTKVEDCRVWAYGYMNIEDHSEYKIGNSLDEFMAWALKVQADLYFH<br>NLKFDGAFIVNWLFKNGFKWCKEAKEERTFSTIISRMGQWYMIDICIGYKGKRKIHTVIYD<br>SLKKLPFPVKKIAQDFKLTVKKGDIDYHKERPVGYKITPEEYAYIKNDIQIIAEALLIQFK<br>QGLDRMTAGSDSLKDFKDIITTKKFKKVFPTLSLGLDKEVRKAYRGGFTWLNDRFKGKEIG<br>EGMVFDINSAYPAQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMF<br>KDFIDKWTYIKTTSYGAIKQLAKLMLNSLYGKFASNPDVTGKVPYLKENGALGFRLGEEET<br>KDPVYTPLASFVTAWGRYTTITTAQACYDRIIYCDTDSIHLTGTKVPDAIKDLVHPKKLGY<br>WEHESTFKRAKYLRQKTYVQDIYMKRVRGYLVQGSPDDYTDIKFSVKCAGMTDKIKEEVTF<br>ENFKVGFSRKMKPKPVQVPGGVVLVDSVFTIK |
| C0320702 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0321703 | | MKHMPRKRYSCDFETTTKVEDCRVWAYGYMNIEDHSEYKIGNSLDEFMAWALKVQADLYFH<br>NLKFDGAFIVNWLFKNGFKWCKEAKEERTFSTIISRMGQWYMIDICIGYKGKRKIHTVIYD<br>SLKKLPFPVKKIAQDFKLTVKKGDIDYHKERPVGYKITPEEYAYIKNDIQIIAEALLIQFK<br>QGLDRMTAGSDSLKDFKDIITTKKFKKVFPTLSLGLDKEVRKAYRGGFTWLNDRFKGKEIG<br>EGMVFDINSAYPAQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMF<br>KDFIDKWTYIKTTSYGAIKQLAKLMLNSLYGKFASNPDVTGKVPYLKENGALGFRLGEEET<br>KDPVYTPLASFVTAWGRYTTITTAQACYDRIIYCDTDSIHLTGTKIPDVIKDIVHPKKLGY<br>WEHESTFKRAKYLRQKTYIQDIYMKRVRGYLVQGSPDDYTDIKFSVKCAGMTDKIKEEVTF<br>ENFKVGFSRKMKPKPVQVPGGVVLVDSVFTIK |
| C0322704 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEETKDP<br>VYTPMGVFITAWGRYTTIAAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0323705 | | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWFYIKTTSYGAIKQLAKLMLNSLYGKFASNPDVTGKVPYLKENGALGFRLGEEETKDP<br>VYTPMGVFITAWGRYTTIAAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |

TABLE 4-continued

Chimeric Polymerase Variants

| Name | SEQ ID NO | Sequence |
|---|---|---|
| C0324706 | | MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDHPLYIQNLKVRFRLKERHIPCIQVKQS
SLFIQNEYLESSVNKLGVDELIELTLTNVDLDLFFEHYEILEIHYTGYMFRASCDMFKDF
IDKWFYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK |
| C0325707 | | MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTGYMFKASCDMFKDF
IDKWFYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK |
| C0326708 | | MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDANSHYPAQMYVRPLPYGTPLFYEGEYKENIDHPLYIQNLKVRFRLKERHIPCIQVKQS
SLFIQNEYLESSVNKLGVDELIELTLTNVDLDLFFEHYEILEIHYTGYMFRASCDMFKDF
IDKWTYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK |
| C0327709 | | MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDANSHYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTGYMFKASCDMFKDF
IDKWTYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK |
| C0328710 | | MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDHPLYIQNLKVRFRLKERHIPCIQVKQS
SLFIQNEYLESSVNKLGVDELIELTLTNVDLDLFFEHYEILEIHYTGYMFRASCDMFKDF
IDKWTYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK |
| C0329711 | | MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTGYMFKASCDMFKDF
IDKWTYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK |
| C0330712 | | MKHMPRKRYSCDFETTTKVEDCRVWAYGYMNIEDHSEYKIGNSLDEFMAWALKVQADLYFH
NLKFDGAFIINWLFKNGFKWCKEAKEERTFSTIISRMGQWYMIDICLGYKGKRKIHTVIYD
SLKKLPFPVKKIAQDFKLTVKKGDIDYHKERPVGYKITPEEYAYIKNDIQIIAEALLIQFK
QGLDRMTAGSDSLKDFKDIITTKKFKKVFPTLSLGLDKEVRKAYRGGFTWLNDRFKGKEIG
EGMVFDANSHYPAQMYVRPLPYGTPLFYEGEYKENIDHPLYIQNLKVRFRLKERHIPCIQV
KQSSLFIQNEYLESSVNKLGVDELIELTLTNVDLDLFFEHYEILEIHYTGYMFRASCDMF
KDFIDKWTYIKTTSYGAIKQLAKLMLNSLYGKFASNPDVTGKVPYLKENGALGFRLGEEET
KDPVYTPMGVFITAWGRYTTITAAQACYDRIIYCDTDSIHLTGTKIPDVIKDIVHPKKLGY |

TABLE 4-continued

Chimeric Polymerase Variants

| Name | SEQ ID NO | Sequence |
|---|---|---|
| | | WEHESTFKRAKYLRQKTYIQDIYMKRVKGYLVQGSPDDYTDIKFSVKCAGMTDKIKEEVTF ENFKVGFSRKMKPKPVQVPGGVVLVDSVFTIK |
| C03317 | 13 | MKHMPRKRYSCDFETTTKVEDCRVWAYGYMNIEDHSEYKIGNSLDEFMAWALKVQADLYFH NLKFDGAFIINWLFKNGFKWCKEAKEERTFSTIISRMGQWYMIDICLGYKGKRKIHTVIYD SLKKLPFPVKKIAQDFKLTVKKGDIDYHKERPVGYKITPEEYAYIKNDIQIIAEALLIQFK QGLDRMTAGSDSLKDFKDIITTKKFKKVFPTLSLGLDKEVRKAYRGGFTWLNDRFKGKEIG EGMVFDANSHYPAQMYVRPLPYGTPLFYEGEYKENIDPLYIQNIKVRFRLKERHIPTIQV KQSSLFIQNEYLESSVNKLGVDELIDLTLTNVDLDLFFEHYDILEIHYTYGYMFKASCDMF KDFIDKWTYIKTTSYGAIKQLAKLMLNSLYGKFASNPDVTGKVPYLKENGALGFRLGEEET KDPVYTPMGVFITAWGRYTTITAAQACYDRIIYCDTDSIHLTGTKIPDVIKDIVHPKKLGY WEHESTFKRAKYLRQKTYIQDIYMKRVKGYLVQGSPDDYTDIKFSVKCAGMTDKIKEEVTF ENFKVGFSRKMKPKPVQVPGGVVLVDSVFTIK |
| C03327 | 14 | MKHMPRKRYSCDFETTTKVEDCRVWAYGYMNIEDHSEYKIGNSLDEFMAWALKVQADLYFH NLKFDGAFIINWLFKNGFKWCKEAKEERTFSTIISRMGQWYMIDICLGYKGKRKIHTVIYD SLKKLPFPVKKIAQDFKLTVKKGDIDYHKERPVGYKITPEEYAYIKNDIQIIAEALLIQFK QGLDRMTAGSDSLKDFKDIITTKKFKKVFPTLSLGLDKEVRKAYRGGFTWLNDRFKGKEIG EGMVFDINSAYPAQMYVRPLPYGTPLFYEGEYKENIDHPLYIQNLKVRFRLKERHIPCIQV KQSSLFIQNEYLESSVNKLGVDELIELTLTNVDLDLFFEHYEILEIHYTYGYMFRASCDMF KDFIDKWTYIKTTSYGAIKQLAKLMLNSLYGKFASNPDVTGKVPYLKENGALGFRLGEEET KDPVYTPMGVFITAWGRYTTITAAQACYDRIIYCDTDSIHLTGTKIPDVIKDIVHPKKLGY WEHESTFKRAKYLRQKTYIQDIYMKRVKGYLVQGSPDDYTDIKFSVKCAGMTDKIKEEVTF ENFKVGFSRKMKPKPVQVPGGVVLVDSVFTIK |
| C03337 | 15 | MKHMPRKRYSCDFETTTKVEDCRVWAYGYMNIEDHSEYKIGNSLDEFMAWALKVQADLYFH NLKFDGAFIINWLFKNGFKWCKEAKEERTFSTIISRMGQWYMIDICLGYKGKRKIHTVIYD SLKKLPFPVKKIAQDFKLTVKKGDIDYHKERPVGYKITPEEYAYIKNDIQIIAEALLIQFK QGLDRMTAGSDSLKDFKDIITTKKFKKVFPTLSLGLDKEVRKAYRGGFTWLNDRFKGKEIG EGMVFDINSAYPAQMYVRPLPYGTPLFYEGEYKENIDYPLYIQNIKVRFRLKERHIPTIQV KQSSLFIQNEYLESSVNKLGVDELIDLTLTNVDLDLFFEHYDILEIHYTYGYMFKASCDMF KDFIDKWTYIKTTSYGAIKQLAKLMLNSLYGKFASNPDVTGKVPYLKENGALGFRLGEEET KDPVYTPMGVFITAWGRYTTITAAQACYDRIIYCDTDSIHLTGTKIPDVIKDIVHPKKLGY WEHESTFKRAKYLRQKTYIQDIYMKRVKGYLVQGSPDDYTDIKFSVKCAGMTDKIKEEVTF ENFKVGFSRKMKPKPVQVPGGVVLVDSVFTIK |
| C03347 | 16 | MSRKRFSCDFETTTKLDDCRVWAYGYMEIGNLDNYKIGNSLDEFMQWAMEIQADLYFHNLK FDGAFIINWLERNGFKWSADGLPNTYNTIISRMGQWYMIDICLGYKGKRKIHTVIYDSLKK LPFPVKKIAQDFKLTVKKGDIDYHKERPVGYKITPEEYAYIKNDIQIIAEALLIQFKQGLD RMTAGSDSLKDFKDIITTKKFKKVFPTLSLGLDKEVRKAYRGGFTWLNDRFKGKEIGEGMV FDINSAYPAQMYVRPLPYGTPLFYEGEYKENIDYPLYIQNIKVRFRLKERHIPTIQVKQSS LFIQNEYLESSVNKLGVDELIDLTLTNVDLDLFFEHYDILEIHYTYGYMFKASCDMFKDFI DKWFYIKTTSYGAIKQLAKLMLNSLYGKFASNPDVTGKVPYLKENGALGFRLGEEETKDPV YTPMGVFITAWGRYTTITAAQACYDRIIYCDTDSIHLTGTKIPDVIKDIVHPKKLGYWEHE STFKRAKYLRQKTYIQDIYMKRVRGYLVQGSPDDYTDIKFSVKCAGMTDKIKEEVTFENFK VGFSRKMKPKPVQVPGGVVLVDSVFTIK |
| C03357 | 17 | MSRKRFSCDFETTTKLDDCRVWAYGYMEIGNLDNYKIGNSLDEFMQWAMEIQADLYFHNLK FDGAFIINWLFKNGFKWCKEAKEERTFSTIISRMGQWYMIDICLGYKGKRKIHTVIYDSLK KLPFPVKKIAQDFKLTVKKGDIDYHKERPVGYKITPEEYAYIKNDIQIIAEALLIQFKQGL DRMTAGSDSLKDFKDIITTKKFKKVFPTLSLGLDKEVRKAYRGGFTWLNDRFKGKEIGEGM VFDINSAYPAQMYVRPLPYGTPLFYEGEYKENIDYPLYIQNIKVRFRLKERHIPTIQVKQS SLFIQNEYLESSVNKLGVDELIDLTLTNVDLDLFFEHYDILEIHYTYGYMFKASCDMFKDF IDKWTYIKTTSYGAIKQLAKLMLNSLYGKFASNPDVTGKVPYLKENGALGFRLGEEETKDP VYTPMGVFITAWGRYTTITAAQACYDRIIYCDTDSIHLTGTKIPDVIKDIVHPKKLGYWEH ESTFKRAKYLRQKTYIQDIYMKRVRGYLVQGSPDDYTDIKFSVKCAGMTDKIKEEVTFENF KVGFSRKMKPKPVQVPGGVVLVDSVFTIK |
| C03367 | 18 | MKHMPRKRYSCDFETTTKLDDCRVWAYGYMEIGNLDNYKIGNSLDEFMAWALKVQADLYFH NLKFDGAFIINWLERNGFKWSADGLPNTYNTIISRMGQWYMIDICLGYKGKRKIHTVIYDS LKKLPFPVKKIAQDFKLTVKKGDIDYHKERPVGYKITPEEYAYIKNDIQIIAEALLIQFKQ GLDRMTAGSDSLKDFKDIITTKKFKKVFPTLSLGLDKEVRKAYRGGFTWLNDRFKGKEIGE GMVFDINSAYPAQMYVRPLPYGTPLFYEGEYKENIDYPLYIQNIKVRFRLKERHIPTIQVK QSSLFIQNEYLESSVNKLGVDELIDLTLTNVDLDLFFEHYDILEIHYTYGYMFKASCDMFK DFIDKWTYIKTTSYGAIKQLAKLMLNSLYGKFASNPDVTGKVPYLKENGALGFRLGEEETK DPVYTPMGVFITAWGRYTTITAAQACYDRIIYCDTDSIHLTGTKIPDVIKDIVHPKKLGYW EHESTFKRAKYLRQKTYIQDIYMKRVRGYLVQGSPDDYTDIKFSVKCAGMTDKIKEEVTFE NFKVGFSRKMKPKPVQVPGGVVLVDSVFTIK |
| C03377 | 19 | MKHMSRKRFSCDFETTTKLDDCRVWAYGYMEIGNLDNYKIGNSLDEFMAWALKVQADLYFH NLKFDGAFIINWLERNGFKWSADGLPNTYNTIISRMGQWYMIDICLGYKGKRKIHTVIYDS LKKLPFPVKKIAQDFKLTVKKGDIDYHKERPVGYKITPEEYAYIKNDIQIIAEALLIQFKQ GLDRMTAGSDSLKDFKDIITTKKFKKVFPTLSLGLDKEVRKAYRGGFTWLNDRFKGKEIGE GMVFDINSAYPAQMYVRPLPYGTPLFYEGEYKENIDYPLYIQNIKVRFRLKERHIPTIQVK |

TABLE 4-continued

Chimeric Polymerase Variants

| Name | SEQ ID NO | Sequence |
|---|---|---|
| | | QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0338720 | | MKHMPRKRYSCDFETTTKLDDCRVWAYGYMEIGNLDNYKIGNSLDEFMAWALKVQADLYFH<br>NLKFDGAFIINWLFKNGFKWCKEAKEERTFSTIISRMGQWYMIDICLGYKGKRKIHTVIYD<br>SLKKLPFPVKKIAQDFKLTVKKGDIDYHKERPVGYKITPEEYAYIKNDIQIIAEALLIQFK<br>QGLDRMTAGSDSLKDFKDIITTKKFKKVFPTLSLGLDKEVRKAYRGGFTWLNDRFKGKEIG<br>EGMVFDINSAYPAQMYVRPLPYGTPLFYEGEYKENIDYPLYIQNIKVRFRLKERHIPTIQV<br>KQSSLFIQNEYLESSVNKLGVDELIDLTLTNVDLDLFFEHYDILEIHYTYGYMFKASCDMF<br>KDFIDKWTYIKTTSYGAIKQLAKLMLNSLYGKFASNPDVTGKVPYLKENGALGFRLGEEET<br>KDPVYTPLASFVTAWGRYTTITTAQACYDRIIYCDTDSIHLTGTKVPDAIKDLVHPKKLGY<br>WEHESTFKRAKYLRQKTYVQDIYMKRVRGYLVQGSPDDYTDIKFSVKCAGMTDKIKEEVTF<br>ENFKVGFSRKMKPKPVQVPGGVVLVDSVFTIK |
| C0339721 | | MKHMPRKRYSCDFETTTKVEDCRVWAYGYMNIEDHSEYKIGNSLDEFMAWALKVQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSHYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPLASFVTAWGRYTTITTAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0340722 | | MKHMPRKRYSCDFETTTKVEDCRVWAYGYMNIEDHSEYKIGNSLDEFMAWALKVQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSHYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0341723 | | MKHMPRKRYSCDFETTTKVEDCRVWAYGYMNIEDHSEYKIGNSLDEFMAWALKVQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPLAVFVTAWGRYTTITTAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0342724 | | MKHMPRKRYSCDFETTTKVEDCRVWAYGYMNIEDHSEYKIGNSLDEFMAWALKVQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPLASFVTAWGRYTTITAAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0343725 | | MKHMPRKRYSCDFETTTKVEDCRVWAYGYMNIEDHSEYKIGNSLDEFMAWALKVQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPLAVFVTAWGRYTTITAAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0344726 | | MKHMSRKRYSCDFETTTKLDDCRVWAYGYMEIGNLDNYKIGNSLDEFMQWAMEIQADLYFH<br>NLKFDGAFIINWLERNGFKWSADGLPNTYNTIISRMGQWYMIDICLGYKGKRKIHTVIYDS |

TABLE 4-continued

Chimeric Polymerase Variants

| Name | SEQ ID NO | Sequence |
|---|---|---|
| | | LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C03457 | 27 | MPRKRYSCDFETTTKVEDCRVWAYGYMEIGNLDNYKIGNSLDEFMQWAMEIQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKEEVTFENFK<br>VGFSRKMKPKPVQVPGGVVLVDSVFTIK |
| C03467 | 28 | MSRKRFSCDFETTTKLDDCRVWAYGYMNIEDHSEYKIGNSLDEFMQWAMEIQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKEEVTFENFK<br>VGFSRKMKPKPVQVPGGVVLVDSVFTIK |
| C03477 | 29 | MSRKRFSCDFETTTKLDDCRVWAYGYMEIGNLDNYKIGNSLDEFMAWALKVQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKEEVTFENFK<br>VGFSRKMKPKPVQVPGGVVLVDSVFTIK |
| C03487 | 30 | MSRKRFSCDFETTTKLDDCRVWAYGYMNIEDHSEYKIGNSLDEFMAWALKVQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKEEVTFENFK<br>VGFSRKMKPKPVQVPGGVVLVDSVFTIK |
| C03497 | 31 | MPRKRYSCDFETTTKVEDCRVWAYGYMEIGNLDNYKIGNSLDEFMAWALKVQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKEEVTFENFK<br>VGFSRKMKPKPVQVPGGVVLVDSVFTIK |
| C03507 | 32 | MPRKRYSCDFETTTKVEDCRVWAYGYMNIEDHSEYKIGNSLDEFMQWAMEIQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFASNPDVTGKVPYLKENGALGFRLGEEETKDPV<br>YTPMGVFITAWGRYTTITAAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKEEVTFENFK<br>VGFSRKMKPKPVQVPGGVVLVDSVFTIK |

TABLE 4-continued

Chimeric Polymerase Variants

| Name | SEQ ID NO | Sequence |
|---|---|---|
| C0351 | 733 | MKHMPRKRYSCDFETTTKLDDCRVWAYGYMEIGNLSEYKIGNSLDEFMQWAMKIQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0352 | 734 | MKHMPRKRYSCDFETTTKLDDCRVWAYGYMEIGNHSEYKIGNSLDEFMQWAMKIQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFASNPDVTGKVPYLKENGALGFRLGEEETK<br>DPVYTPMGVFITAWGRYTTITAAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMTDKIKEEVTFE<br>NFKVGFSRKMKPKPVQVPGGVVLVDSVFTIK |
| C0352 B | 735 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFASNPDVTGKVPYLKENGALGFRLGEEEETKDP<br>VYTPMGVFITAWGRYTTITAAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0353 | 736 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFGTNPDITGKVPYMGEDGIVRLTLGEEETKDP<br>VYTPMGVFITAWGRYTTITAAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMPDRIKELVTFDNF<br>EVGFSSYGKLLPKRTQGGVVLVDTMFTIK |
| C0354 | 737 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFGTNPDITGKVPYMGEDGIVRLTLGEEETKDP<br>VYTPMGVFITAWGRYTTITAAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0355 | 738 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSHYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWFYIKTTSYGAIKQLAKLMLNSLYGKFGTNPDITGKVPYMGEDGIVRLTLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMPDRIKELVTFDNF<br>EVGFSSYGKLLPKRTQGGVVLVDTMFTIK |
| C0356 | 739 | MSRKRFSCDFETTTKLDDCRVWAYGYMEIGNLDNYKIGNSLDEFMQWAMEIQADLYFHNLK<br>FDGAFIINWLERNGFKWSADGLPNTYNTIISRMGQWYMIDICLGYKGKRKIHTVIYDSLK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFGTNPDITGKVPYMGEDGIVRLTLGEEETKDPV |

TABLE 4-continued

Chimeric Polymerase Variants

| Name | SEQ ID NO | Sequence |
|---|---|---|
| | | YTPMGVFITAWGRYTTITAAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMPDRIKELVTFDNFE<br>VGFSSYGKLLPKRTQGGVVLVDTMFTIK |
| C0357 | 740 | MKHMPRKRYSCDFETTTKVEDCRVWAYGYMNIEDHSEYKIGNSLDEFMAWALKVQADLYFH<br>NLKFDGAFIINWLERNGFKWSADGLPNTYNTIISRMGQWYMIDICLGYKGKRKIHTVIYDS<br>LKKLPFPVKKIAQDFKLTVKKGDIDYHKERPVGYKITPEEYAYIKNDIQIIAEALLIQFKQ<br>GLDRMTAGSDSLKDFKDIITTKKFKKVFPTLSLGLDKEVRKAYRGGFTWLNDRFKGKEIGE<br>GMVFDINSAYPAQMYVRPLPYGTPLFYEGEYKENIDYPLYIQNIKVRFRLKERHIPTIQVK<br>QSSLFIQNEYLESSVNKLGVDELIDLTLTNVDLDLFFEHYDILEIHYTYGYMFKASCDMFK<br>DFIDKWTYIKTTSYGAIKQLAKLMLNSLYGKFGTNPDITGKVPYMGEDGIVRLTLGEEETK<br>DPVYTPLASFVTAWGRYTTITTAQACYDRIIYCDTDSIHLTGTKIPDVIKDIVHPKKLGYW<br>EHESTFKRAKYLRQKTYIQDIYMKRVRGYLVQGSPDDYTDIKFSVKCAGMPDRIKELVTFD<br>NFEVGFSSYGKLLPKRTQGGVVLVDTMFTIK |
| C0358 | 741 | MSRKRFSCDFETTTKLDDCRVWAYGYMEIGNLDNYKIGNSLDEFMQWAMEIQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFGTNPDITGKVPYMGEDGIVRLTLGEEETKDPV<br>YTPLASFVTAWGRYTTITTAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMTDKIKEEVTFENFK<br>VGFSRKMKPKPVQVPGGVVLVDSVFTIK |
| C0359 | 742 | MSRKRFSCDFETTTKLDDCRVWAYGYMEIGNLDNYKIGNSLDEFMQWAMEIQADLYFHNLK<br>FDGAFIINWLERNGFKWSADGLPNTYNTIISRMGQWYMIDICLGYKGKRKIHTVIYDSLKK<br>LPFPVKKIAQDFKLTVKKGDIDYHKERPVGYKITPEEYAYIKNDIQIIAEALLIQFKQGLD<br>RMTAGSDSLKDFKDIITTKKFKKVFPTLSLGLDKEVRKAYRGGFTWLNDRFKGKEIGEGMV<br>FDINSAYPAQMYVRPLPYGTPLFYEGEYKENIDYPLYIQNIKVRFRLKERHIPTIQVKQSS<br>LFIQNEYLESSVNKLGVDELIDLTLTNVDLDLFFEHYDILEIHYTYGYMFKASCDMFKDFI<br>DKWTYIKTTSYGAIKQLAKLMLNSLYGKFGTNPDITGKVPYMGEDGIVRLTLGEEETKDPV<br>YTPLASFVTAWGRYTTITTAQACYDRIIYCDTDSIHLTGTKIPDVIKDIVHPKKLGYWEHE<br>STFKRAKYLRQKTYIQDIYMKRVRGYLVQGSPDDYTDIKFSVKCAGMPDRIKELVTFDNFE<br>VGFSSYGKLLPKRTQGGVVLVDTMFTIK |
| C0360 | 743 | MSRKMFSCDFETTTKLDDCRVWAYGYMEIGNLDNYKIGNSLDEFMQWVMEIQADLYFHNLK<br>FDGAFIINWLFKNGFKWCKEAKEERTFSTIISRMGQWYMIDICLGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKEGYIPTIQIKQS<br>LFYKGNEYLKSSGGELIDLTLTNVDLDLFFEHYDILEIHYTYGYMFKASCDMFKDFIDKWT<br>YIKTTSYGAIKQLAKLMLNSLYGKFASNPDVTGKVPYLKENGALGFRLGEEETKDPVYTPM<br>GVFITAWGRYTTITAAQACYDRIIYCDTDSIHLTGTKIPDVIKDIVHPKKLGYWEHESTFK<br>RAKYLRQKTYIQDIYMKRVRGYLVQGSPDDYTDIKFSVKCAGMTDKIKEEVTFENFKVGFS<br>RKMKPKPVQVPGGVVLVDSVFTIK |
| C0361 | 744 | MSRKMFSCDFETTTKLDDCRVWAYGYMEIGNLDNYKIGNSLDEFMQWVMEIQADLYFHNLK<br>FDGAFIINWLFKNGFKWCKEAKEERTFSTIISRMGQWYMIDICLGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0362 | 745 | MSRKMFSCDFETTTKLDDCRVWAYGYMEIGNLDNYKIGNSLDEFMQWVMEIQADLYFHNLK<br>FDGAFIINWLFKNGFKWCKEAKEERTFSTIISRMGQWYMIDICLGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM<br>VFDINSAYPAQMYVRPLPYGTPLFYEGEYKENIDHPLYIQNLKVRFRLKERHIPCIQVKRS<br>RLFIQNEYLESSVNELIELTLTNVDLDLFFEHYEILEIHYTYGYMFRASCDMFKDFIDKWT<br>YIKTTSYGAIKQLAKLMLNSLYGKFASNPDVTGKVPYLKENGALGFRLGEEETKDPVYTPM<br>GVFITAWGRYTTITAAQACYDRIIYCDTDSIHLTGTKIPDVIKDIVHPKKLGYWEHESTFK<br>RAKYLRQKTYIQDIYMKRVRGYLVQGSPDDYTDIKFSVKCAGMTDKIKEEVTFENFKVGFS<br>RKMKPKPVQVPGGVVLVDSVFTIK |
| C0363 | 746 | MSRKMFSCDFETTTKLDDCRVWAYGYMEIGNLDNYKIGNSLDEFMQWVMEIQADLYFHNLK<br>FDGAFIINWLFKNGFKWCKEAKEERTFSTIISRMGQWYMIDICLGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKGFKDIITTKKFKKVFPTLSLGLDKEVRKAYRGGFTWLNDRFKGKEIGEGM |

TABLE 4-continued

Chimeric Polymerase Variants

| Name | SEQ ID NO | Sequence |
|---|---|---|

VFDINSAYPAQMYVRPLPYGTPLFYEGEYKENIDHPLYIQNLKVRFRLKEGYIPTIQIKRS
RFYKGNEYLKSSGGELIELTLTNVDLELMKEHYEILEIHYTYGYMFRASCDMFKDFIDKWT
YIKTTSYGAIKQLAKLMLNSLYGKFASNPDVTGKVPYLKENGALGFRLGEEETKDPVYTPM
GVFITAWGRYTTITAAQACYDRIIYCDTDSIHLTGTKIPDVIKDIVHPKKLGYWEHESTFK
RAKYLRQKTYIQDIYMKRVRGYLVQGSPDDYTDIKFSVKCAGMTDKIKEEVTFENFKVGFS
RKMKPKPVQVPGGVVLVDSVFTIK

C0364747 MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDANSAYPAQMYVRPLPYGTPLFYEGEYKENIDHPLYIQNLKVRFRLKERHIPCIQVKQS
SLFIQNEYLESSVNKLGVDELIELTLTNVDLDLFFEHYEILEIHYTYGYMFRASCDMFKDF
IDKWFYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK

C0365748 MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSHYPAQMYVRPLPYGTPLFYEGEYKENIDHPLYIQNLKVRFRLKERHIPCIQVKQS
SLFIQNEYLESSVNKLGVDELIELTLTNVDLDLFFEHYEILEIHYTYGYMFRASCDMFKDF
IDKWFYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK

C0366749 MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDHPLYIQNLKVRFRLKERHIPCIQVKQS
SLFIQNEYLESSVNKLGVDELIELTLTNVDLDLFFEHYEILEIHYTYGYMFRASCDMFKDF
IDKWFYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK

C0367750 MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDVNSAYPAQMYVRPLPYGTPLFYEGEYKENIDHPLYIQNLKVRFRLKERHIPCIQVKQS
SLFIQNEYLESSVNKLGVDELIELTLTNVDLDLFFEHYEILEIHYTYGYMFRASCDMFKDF
IDKWFYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK

C0368751 MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDVNSAYPAQMYVRPLPYGTPLFYEGEYKENIDHPLYIQNLKVRFRLKERHIPCIQVKQS
SLFIQNEYLESSVNKLGVDELIELTLTNVDLDLFFEHYEILEIHYTYGYMFRASCDMFKDF
IDKWTYIKTTSYGAIKQLAKLMLNSLYGKFASNPDVTGKVPYLKENGALGFRLGEEETKDP
VYTPMGVFITAWGRYTTITAAQACYDRIIYCDTDSIHLTGTKIPDVIKDIVHPKKLGYWEH
ESTFKRAKYLRQKTYIQDIYMKRVKGYLVQGSPDDYTDIKFSVKCAGMTDKIKEEVTFENF
KVGFSRKMKPKPVQVPGGVVLVDSVFTIK

C0369752 MSRKRFSCDFETTTKLDDCRVWAYGYMEIGNLDNYKIGNSLDEFMQWAMEIQADLYFHNLK
FDGAFIINWLFKNGFKWCKEAKEERTFSTIISRMGQWYMIDICLGYKGKRKIHTVIYDSLK
KLPFPVEKIAKDFKLTVKKGDIDIHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDHPLYIQNLKVRFRLKERHIPCIQVKQS

TABLE 4-continued

Chimeric Polymerase Variants

| Name | SEQ ID NO | Sequence |
|---|---|---|
| | | SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0370 | 753 | MSRKRFSCDFETTTKLDDCRVWAYGYMEIGNLDNYKIGNSLDEFMQWAMEIQADLYFHNLK<br>FDGAFIINWLFKNGFKWCKEAKEERTFSTIISRMGQWYMIDICLGYKGKRKIHTVIYDSLK<br>KLPFPVEKIAKDFKLTVKKGDIDIHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDANSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPMGVFITAWGRYTTITAAQACYDRIIYCDTDSIHLTGTKIPDVIKDIVHPKKLGYWEH<br>ESTFKRAKYLRQKTYIQDIYMKRVKGYLVQGSPDDYTDIKFSVKCAGMTDKIKEEVTFENF<br>KVGFSRKMKPKPVQVPGGVVLVDSVFTIK |
| C0371 | 754 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0372 | 755 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0373 | 756 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTYGYMFRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0374 | 757 | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0375 | 758 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKDDGSLGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0376 | 759 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK |

TABLE 4-continued

Chimeric Polymerase Variants

| Name | SEQ ID NO | Sequence |
|------|-----------|----------|
| | | KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTYGYMFKASCDMFKDF
IDKWTYIKTTSYGAIKQLAKLMLNSLYGKFASNPDVTGKVPYLKDDGILGFRVGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVRGYLVQGSPDDYTDIKFSVKCAGMTDKIKEEVTFENF
KVGFSRKMKPKPVQVPGGVVLVDSVFTIK |
| C0377760 | | MSRKMFSCDFETTTKLDDCRVWAYGYMEIGNLDNYKIGNSLDEFMQWVMEIQADLYFHNLK
FDGAFIVNWLFKNGFKWCKEAKEERTFSTIISRMGQWYMIDICIGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTYGYMFKASCDMFKDF
IDKWTYIKTTSYGAIKQLAKLMLNSLYGKFASNPDVTGKVPYLKDDGALGFRVGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVRGYLVQGSPDDYTDIKFSVKCAGMTDKIKEEVTFENF
KVGFSRKMKPKPVQVPGGVVLVDSVFTIK |
| C0378761 | | MSRKMFSCDFETTTKLDDCRVWAYGYMEIGNLDNYKIGNSLDEFMQWVMEIQADLYFHNLK
FDGAFIVNWLFKNGFKWCKEAKEERTFSTIISRMGQWYMIDICIGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTYGYMFKASCDMFKDF
IDKWTYIKTTSYGAIKQLAKLMLNSLYGKFASNPDVTGKVPYLKEDGALGFRVGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVRGYLVQGSPDDYTDIKFSVKCAGMTDKIKEEVTFENF
KVGFSRKMKPKPVQVPGGVVLVDSVFTIK |
| C0379762 | | MSRKMFSCDFETTTKLDDCRVWAYGYMEIGNLDNYKIGNSLDEFMQWVMEIQADLYFHNLK
FDGAFIVNWLFKNGFKWCKEAKEERTFSTIISRMGQWYMIDICIGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTYGYMFKASCDMFKDF
IDKWTYIKTTSYGAIKQLAKLMLNSLYGKFASNPDVTGKVPYLKEDGIVRLTLGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVRGYLVQGSPDDYTDIKFSVKCAGMTDKIKEEVTFENF
KVGFSRKMKPKPVQVPGGVVLVDSVFTIK |
| C0380763 | | MSRKMFSCDFETTTKLDDCRVWAYGYMEIGNLDNYKIGNSLDEFMQWVMEIQADLYFHNLK
FDGAFIVNWLFKNGFKWCKEAKEERTFSTIISRMGQWYMIDICIGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTYGYMFKASCDMFKDF
IDKWTYIKTTSYGAIKQLAKLMLNSLYGKFASNPDVTGKVPYLKEDGIVGFRLGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVRGYLVQGSPDDYTDIKFSVKCAGMTDKIKEEVTFENF
KVGFSRKMKPKPVQVPGGVVLVDSVFTIK |
| C0381764 | | MSRKMFSCDFETTTKLDDCRVWAYGYMEIGNLDNYKIGNSLDEFMQWVMEIQADLYFHNLK
FDGAFIVNWLFKNGFKWCKEAKEERTFSTIISRMGQWYMIDICIGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTYGYMFKASCDMFKDF
IDKWTYIKTTSYGAIKQLAKLMLNSLYGKFASNPDVTGKVPYLKDDGIVGFRLGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVRGYLVQGSPDDYTDIKFSVKCAGMTDKIKEEVTFENF
KVGFSRKMKPKPVQVPGGVVLVDSVFTIK |
| C0382765 | | MSRKMFSCDFETTTKLDDCRVWAYGYMEIGNLDNYKIGNSLDEFMQWVMEIQADLYFHNLK
FDGAFIVNWLFKNGFKWCKEAKEERTFSTIISRMGQWYMIDICIGYKGKRKIHTVIYDSLK
KLPFPVKKIAQDFKLTVKKGDIDYHKERPVGYKITPEEYAYIKNDIQIIAEALLIQFKQGL
DRMTAGSDSLKDFKDIITTKKFKKVFPTLSLGLDKEVRKAYRGGFTWLNDRFKGKEIGEGM
VFDINSAYPAQMYVRPLPYGTPLFYEGEYKENIDYPLYIQNIKVRFRLKERHIPTIQVKQS
SLFIQNEYLESSVNKLGVDELIDLTLTNVDLDLFFEHYDILEIHYTYGYMFKASCDMFKDF
IDKWTYIKTTSYGAIKQLAKLMLNSLYGKFASNPDVTGKVPYLKDDGIVGFRVGEEETKDP
VYTPLASFVTAWGRYTTITTAQACYDRIIYCDTDSIHLTGTKIPDVIKDIVHPKKLGYWEH
ESTFKRAKYLRQKTYIQDIYMKRVRGYLVQGSPDDYTDIKFSVKCAGMTDKIKEEVTFENF
KVGFSRKMKPKPVQVPGGVVLVDSVFTIK |

TABLE 4-continued

Chimeric Polymerase Variants

| Name | SEQ ID NO | Sequence |
|---|---|---|
| C0383766 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKDDGAVGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0384767 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGIVGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0385768 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFDNF<br>KVGFSRKMKPKPKQVPGGVVLVDSVFTIK |
| C0386769 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFDNF<br>KVGFSRKMKPKPVQVPGGVVLVDSVFTIK |
| C0387770 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFDNF<br>KVGFSRKMKPKPVQTPGGVVLVDSVFTIK |
| C0388771 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFENF<br>KVGFSRKMKPKPVQTPGGVVLVDSVFTIK |
| C0389772 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP |

TABLE 4-continued

Chimeric Polymerase Variants

| Name | SEQ ID NO | Sequence |
|---|---|---|
| | | VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDTIKEEVTFDNF<br>KVGFSRKMKPKPKQVPGGVVLVDSVFTIK |
| C0390 | 773 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMPKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDTIKEEVTFDNF<br>KVGFSRKMKPKPVQVPGGVVLVDSVFTIK |
| C0391 | 774 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMPKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDTIKEEVTFDNF<br>KVGFSRKMKPKPVQTPGGVVLVDSVFTIK |
| C0392 | 775 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPIGYKITPEEYAYIKNDIQIIAEALLIQFKQGL<br>DRMTAGSDSLKDFKDILTTKKFKKVFPTLSLGLDKEIRKAYRGGFTWVNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMPKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0393 | 776 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDILTTKKFKKVFPTLSLGLDKEIRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMPKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0394 | 777 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDILTTKKFKKVFPTLSLGLDKEIRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMPKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0395 | 778 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYQGEYKENIDHPLYIQNLKVRFRLKERHIPCIQVKQN<br>SLFIQNEYLESSVNKLGVDELIELTLTNVDLDLFFEHYEILEIHYTYGYMPRASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0396 | 779 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM |

TABLE 4-continued

Chimeric Polymerase Variants

| Name | SEQ ID NO | Sequence |
|---|---|---|
| | | VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKDDGALGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0397780 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGIVGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0398781 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGIVGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFDNF<br>KVGFSRKMKPKPKQVPGGVVLVDSVFTIK |
| C0399782 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGIVGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFDNF<br>KVGFSRKMKPKPVQTPGGVVLVDSVFTIK |
| C0400783 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDILTTKKFKKVFPTLSLGLDKEIRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGIVGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFDNF<br>KVGFSRKMKPKPVQTPGGVVLVDSVFTIK |
| C0401784 | | MSRKRFSCDFETTTKLDDCRVWAYGYMEIGNLDNYKIGNSLDEFMQWAMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDILTTKKFKKVFPTLSLGLDKEIRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF<br>IDKWTYIKTTSYGAIKQLAKLMLNSLYGKFASNPDVTGKVPYLKENGIVGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFDNF<br>KVGFSRKMKPKPVQTPGGVVLVDSVFTIK |
| C0402785 | | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTLISRMGQWYMIDICIGYKGKRKIHTVIYDSLK<br>KLPFPVKKIAQDFKLTVKKGDIDYHKERPIGYKITPEEYAYIKNDIQIIAEALLIQFKQGL<br>DRMTAGSDSLKDFKDILTTKKFKKVFPTLSLGLDKEIRKAYRGGFTWLNDRFKGKEIGEGM<br>VFDINSAYPAQMYVRPLPYGTPLFYEGEYKENIDHPLYIQNLKVRFRLKERHIPCIQVKQS<br>SLFIQNEYLESSVNKLGVDELIELTLTNVDLDLFFEHYEILEIHYTGYMFRASCDMFKDF |

TABLE 4-continued

Chimeric Polymerase Variants

| Name | SEQ ID NO | Sequence |
|---|---|---|
| | | IDKWTYIKTTSYGAIKQLAKLMLNSLYGKFASNPDVTGKVPYLKENGIVGFRVGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDRIKEEVTFDNF<br>KVGFSRKMKPKPVQTPGGVVLVDSVFTIK |
| C0403 | 786 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKDDGSLGFRVGDEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0404 | 787 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKDDGSLGFRVGDEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDTIKEEVTFDNF<br>AVGFSRKMKPKPVQVPGGVVLVDSVFTIK |
| C0405 | 788 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLAVFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0406 | 789 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKKLTTIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0407 | 790 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKQRTIFYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0408 | 791 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKQRTIFYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0409 | 792 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKNHVVIYDSLK<br>KLPFPVKKIAQDFKLTVKKGDIDYHKERPVGYKITPEEYAYIKNDIQIIAEALLIQFKQGL |

TABLE 4-continued

Chimeric Polymerase Variants

| Name | SEQ ID NO | Sequence |
|---|---|---|
| | | DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0410 | 793 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKNHVVFYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0411 | 794 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKGTTQIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0412 | 795 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKFRVEIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0413 | 796 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKFRVEFYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDRFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0414 | 797 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNDKYKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0415 | 798 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNPKYKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |

TABLE 4-continued

Chimeric Polymerase Variants

| Name | SEQ ID NO | Sequence |
|---|---|---|
| C0416 | 799 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNPKFKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0417 | 800 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLNPRYKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0418 | 801 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLDPKYKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |
| C0419 | 802 | MSRKMFSCDFETTTKLDDCRVWAYGYMEIGNLDNYKIGNSLDEFMQWVMEIQADLYFHNLK<br>FDGAFIVNWLFKNGFKWCKEAKEERTFSTIISRMGQWYMIDICIGYKGKRKIHTVIYDSLK<br>KLPFPVKKIAQDFKLTVKKGDIDYHKERPVGYKITPEEYAYIKNDIQIIAEALLIQFKQGL<br>DRMTAGSDSLKDFKDIITTKKFKKVFPTLSLGLDKEVRKAYRGGFTWLDPRYKGKEIGEGM<br>VFDINSAYPAQMYVRPLPYGTPLFYEGEYKENIDYPLYIQNIKVRFRLKERHIPTIQVKQS<br>SLFIQNEYLESSVNKLGVDELIDLTLTNVDLDLFFEHYDILEIHYTYGYMFKASCDMFKDF<br>IDKWTYIKTTSYGAIKQLAKLMLNSLYGKFASNPDVTGKVPYLKENGALGFRLGEEETKDP<br>VYTPLASFVTAWGRYTTITTAQACYDRIIYCDTDSIHLTGTKIPDVIKDIVHPKKLGYWEH<br>ESTFKRAKYLRQKTYIQDIYMKRVRGYLVQGSPDDYTDIKFSVKCAGMTDKIKEEVTFENF<br>KVGFSRKMKPKPVQVPGGVVLVDSVFTIK |

TABLE 5

Chimeric Polymerases - Substituted Portions

| Name | Majority Sequence | Source of Substituted Sequence | Region(s)/Portion(s) Substituted |
|---|---|---|---|
| C001 | Q001 | M2Y (SEQ ID NO: 6) | Exonuclease, TPR1 |
| C002 | Q001 | M2Y (SEQ ID NO: 6) | Exonuclease, TPR1 |
| C003 | Q001 | M2Y (SEQ ID NO: 6) | Exonuclease, TPR1 |
| C010 | Q001 | *Enterococcus faecium* (SEQ ID NO: 2) | Exonuclease |
| C011 | Q001 | *Enterococcus faecium* (SEQ ID NO: 2) | Exonuclease |
| C012 | Q001 | *Enterococcus faecium* (SEQ ID NO: 2) | TPR1 |
| C013 | Q001 | *Enterococcus faecium* (SEQ ID NO: 2) | TPR1 |
| C014 | Q001 | *Enterococcus faecium* (SEQ ID NO: 2) | Exonuclease, TPR1 |
| C015 | Q001 | *Enterococcus faecium* (SEQ ID NO: 5) | Exonuclease, TPR1 |
| C016 | Q002 | M2Y (SEQ ID NO: 6) | Exonuclease |
| C017 | Q001 | M2Y (SEQ ID NO: 6) | Exonuclease |
| C018 | Q001 | M2Y (SEQ ID NO: 6) | TPR1 |

TABLE 5-continued

Chimeric Polymerases - Substituted Portions

| Name | Majority Sequence | Source of Substituted Sequence | Region(s)/Portion(s) Substituted |
|---|---|---|---|
| C019 | Q001 | M2Y (SEQ ID NO: 6) | Exonuclease, TPR1 |
| C020 | Q001 | *Lucilia cuprina* (SEQ ID NO: 7) | Exonuclease |
| C021

TABLE 5-continued

| | | Chimeric Polymerases - Substituted Portions | |
|---|---|---|---|
| Name | Majority Sequence | Source of Substituted Sequence | Region(s)/Portion(s) Substituted |
| C0256 | Q035 | M2Y (SEQ ID NO: 6), Enterococcus faecium (SEQ ID NO: 2) | residues 1-51 from M2Y substituted in place of 1-54; residues 72-89 from E. faecium substituted in place of 75-91 |
| C0267 | Q035 | M2Y (SEQ ID NO: 6), Enterococcus faecium (SEQ ID NO: 2) | residues 271-375 from E. faecium substituted in place of 260-359; residues 1-51 from M2Y substituted in place of 1-54; residues 445-449 from E. faecium substituted in place of 429-433 |
| C0320 | Q035 | M2Y (SEQ ID NO: 6), Enterococcus faecium (SEQ ID NO: 2) | residues 271-375 from E. faecium substituted in place of 260-359; residues 1-51 from M2Y substituted in place of 1-54; residues 72-89 from E. faecium substituted in place of 75-91; residues 445-449 from E. faecium substituted in place of 429-433 |
| C0334 | Q035 | M2Y (SEQ ID NO: 6), Enterococcus faecium (SEQ ID NO: 2) | residues 271-375 from E. faecium substituted in place of 260-359; residues 1-51 from M2Y substituted in place of 1-54 |
| C0364 | Q035 | M2Y (SEQ ID NO: 6), Enterococcus faecium (SEQ ID NO: 2) | residues 271-375 from E. faecium substituted in place of 260-359; residues 1-51 from M2Y substituted in place of 1-54; residues 72-89 from E. faecium substituted in place of 75-91; residues 445-449 from E. faecium substituted in place of 429-433 |

TABLE 6

| | | Chimeric Polymerases - Site-Specific Mutants |
|---|---|---|
| Name | Majority Sequence | Description |
| C004 | C017 | L259I, E264D, E269D, E276D, D277E, E293D |
| C005 | C017 | L259I, E264D, E269D, E276D, D277E, E288D, E293D, E319D, I320L, A321V, D322E |
| C006 | C017 | L259I, E264D, E269D, E276D, D277E, E288D, E293D, E319D, I320L, A321V, D322E L325I, N327Q, L330I, E331D, D338E, I345L, L348I, K351R, L356I |
| C007 | C017 | K15R, I37L, Q52N, I67L, K77R |
| C008 | C017 | K15R, I37L, Q52N, I67L, K77R, L259I, E264D, E269D, E276D, D277E, E288D, E293D, E319D, I320L, A321V, D322E L325I, N327Q, L330I, E331D, D338E, I345L, L348I, K351R, L356I |
| C009 | C006 | L259I, E264D, E269D, E276D, D277E, E288D, E293D, I320L, A321V, D322E, W324Y, L325V, S326T, V328I, E331D, M333I, D338E, I345L, K351R |
| C025 | C017 | I464V, D466E, V467A, K469E, D470H, I471L, P474S, K487Q, Y491F, L492I |
| C026 | C017 | I464V, D466E, V467A, K469E, D470H, I47IL, K487Q, Y491F, L492I |
| C027 | C017 | M503V, R505K, K507R, G513C, D517E, Y518A, D520T, I521T |
| C028 | C017 | Mutations in 464-497 and 498-554 regions |

TABLE 7

Exemplary modification combinations - positions corresponding to SEQ ID NO: 2.

| Comb. No. | Description |
|---|---|
| 1 | Y148I, A484E |
| 2 | Y148I, V250A, L253H |
| 3 | Y148I, V250A, L253A |
| 4 | Y148I, V250A, L253H, E375Y |
| 5 | Y148I, V250A, L253H, E375Y, A484E |
| 6 | S267A, I384T, N388T A396Q, N397L G400L, K500E, Q506K, S493P (positions corresponding to SEQ ID NO: 2); Y148I, V250A, L253H, E375Y (positions corresponding to SEQ ID NO: 1) |
| 7 | S267A, A396Q, G400L, K500E (positions corresponding to SEQ ID NO: 2); Y148I, V250A, L253H, E375Y (positions corresponding to SEQ ID NO: 1) |
| 8 | Y148I with Loop (positions corresponding to SEQ ID NO: 1) |
| 9 | L264H, K500E, N59D |
| 10 | L264H, V261A, K500E, N59D |
| 11 | L264H, K TABLE 7-continued Exemplary modification combinations - positions corresponding to SEQ ID NO: 2.

| Comb. No. | Description |
|---|---|
| 12 | L264H, V261A, K500E, I384F, N59D |
| 13 | L264A, K500E, N59D |
| 14 | L264A, V261I, K500E, N59D |
| 15 | L264A, K500E, I384F, N59D |
| 16 | L264A, V261I, K500E, I384F, N59D |
| 17 | I384F, N59D |
| 18 | I384F, E391Y, N59D |
| 19 | I384F, E391Y, L264H, N59D |
| 20 | I384F, E391Y, L264A, N59D |
| 21 | I384F, E391Y, L264H, V261A, N59D |
| 22 | I384F, E391Y, L264A, V261I, N59D |
| 23 | K4R, N59D |
| 24 | D232K, N59D |
| 25 | Q513D, N59D |
| 26 | R308G, N59D |
| 27 | E60L, N59D |
| 28 | D341T, N59D |
| 29 | D337G, N59D |
| 30 | S22A, N59D |
| 31 | E85P, N59D |
| 32 | T211A, N59D |
| 33 | N106G, N59D |
| 34 | Q122V, N59D |
| 35 | T479V, N59D |
| 36 | S493P, N59D |
| 37 | E139K, E142K, E391Y, D521K, E482K, D492H, N59D |
| 38 | I148K, E391Y, E523K, E482K, D492H, N59D |
| 39 | I148K, E391Y, E523K, E482K, D492H, S22A, D341T, D337G, L264H, N59D |
| 40 | K4R, Q513D, D232K, E139K, E142K, E391Y, D521K, E482K, D492H, L264H, K500E, V261A, I384F, N59D |
| 41 | K4R, Q513D, D232K, E139K, E142K, E391Y, D521K, E482K, D492H, R308G, E60L, L264H, K500E, I384F, N59D |
| 42 | K4R, Q513D, E139Q, E142K, I148K, D167P, E391Y, E482K, D492H, D521K,E523K, R308G, E60L, S22A, E85P, T211A, N106G, T479V, S493P, QI22V, L264A, K500E, V261I, I384F, N59D |
| 43 | L264H, V261A, K500E, R308G |
| 44 | L264H, V261A, K500E, E391Y, R308G |
| 45 | L264H, V261A, K500E, I384F, R308G |
| 46 | L264H, V261A, K500E, I384F, E391Y, R308G |
| 47 | L264H, V261A, K500E, E391Y, R308G, I148K, E482K, D492H |
| 48 | L264H, V261A, K500E, E391Y, R308G, I148K, E523K, D521K, E482K, D492H |
| 49 | L264H, V261A, K500E, I384F, E391Y, R308G, I148K, E482K, D492H |
| 50 | L264H, V261A, K500E, I384F, E391Y, R308G, I148K, E523K, D521K, E482K, D492H |
| 51 | L264H, V261A, K500E, E391Y, R308G, S22A, D341T, D337G, I148K, E482K, D492H |
| 52 | L264H, V261A, K500E, E391Y, R308G, S22A, D341T, D337G, I148K, E523K, D521K, E482K, D492H |
| 53 | L264H, V261A, K500E, I384F, E391Y, R308G, S22A, D341T, D337G, I148K, E482K, D492H |
| 54 | L264H, V261A, K500E, I384F, E391Y, R308G, S22A, D341T, D337G, I148K, E523K, D521K, E482K, D492H |
| 55 | L264H, V261A, K500E, R308G, I148K, E482K, D492H |
| 56 | L264H, V261A, K500E, R308G, I148K, E523K, D521K, E482K, D492H |
| 57 | L264H, V261A, K500E, I384F, R308G, I148K, E482K, D492H |
| 58 | L264H, V261A, K500E, I384F, R308G, I148K, E523K, D521K, E482K, D492H |
| 59 | L264H, V261A, K500E, R308G, I148K, E391Y, E523K, E482K, D492H, E142K, E537K, D171K, D521K |
| 60 | L264H, V261A, K500E, R308G, I148K, E391Y, E523K, E482K, D492H, E139K, D189K, E537K, D171K |
| 61 | L264H, V261A, K500E, R308G, I148K, E391Y, E523K, E482K, D492H, E139K, E537K, D171K, D521K |
| 62 | L264H, V261A, K500E, R308G, I148K, E391Y, E523K, E482K, D492H, E142K, D189K, E537K, D521K |
| 63 | L264H, V261A, K500E, R308G, I148K, E391Y, E523K, E482K, D492H, D189K, E537K, D167P, D171K |
| 64 | L264H, V261A, K500E, R308G, I148K, E391Y, E523K, E482K, D492H, E142K, E537K, D167P, D521K |
| 65 | L264H, V261A, K500E, R308G, I148K, E391Y, E523K, E482K, D492H, E142K, D189K, D171K, D521K |
| 66 | L264H, V261A, K500E, R308G, I148K, E391Y, E523K, E482K, D492H, E139K, D167P, D171K, D521K |
| 67 | L264H, V261A, K500E, R308G, I148K, E391Y, E523K, E482K, D492H, E142K, D189K, E537K, D167P |
| 68 | L264H, V261A, K500E, R308G, I148K, E391Y, E523K, E482K, D492H, D189K, D167P, D171K, D521K |
| 69 | EMF37 with TRP1 from phi29 |
| 70 | Combination 62 + P136T |
| 71 | Combination 62 + L320M |
| 72 | Combination 62 + E338K |

TABLE 7-continued

Exemplary modification combinations - positions corresponding to SEQ ID NO: 2.

| Comb. No. | Description |
|---|---|
| 73 | Combination 62 + E523V |
| 74 | Combination 65 + P136T |
| 75 | Combination 65 + L320M |
| 76 | Combination 65 + E338K |
| 77 | Combination 65 + E523V |
| 78 | Combination 62 + bis biotin |
| 79 | Combination 62 + bis-biotin-N term His |
| 80 | Combination 79 + L264H, V261, K500E, R308G, I148K, E391Y, E523K, E482K, D492H, E142K, D189K, E537K, D521K |
| 81 | Combination 79 + L264H, V261I, K500E, R308G, I148K, E391Y, E523K, E482K, D492H, E142K, D189K, E537K, D521K |
| 82 | Combination 79 + L264A, V261A, K500E, R308G, I148K, E391Y, E523K, E482K, D492H, E142K, D189K, E537K, D521K |
| 83 | Combination 79 + L264A, V261V, K500E, R308G, I148K, E391Y, E523K, E482K, D492H, E142K, D189K, E537K, D521K |
| 84 | Combination 79 + L264A, V261I, K500E, R308G, I148K, E391Y, E523K, E482K, D492H, E142K, D189K, E537K, D521K |
| 85 | Combination 79 + L264M, V261A, K500E, R308G, I148K, E391Y, E523K, E482K, D492H, E142K, D189K, E537K, D521K |
| 86 | Combination 79 + L264M, V261V, K500E, R308G, I148K, E391Y, E523K, E482K, D492H, E142K, D189K, E537K, D521K |
| 87 | Combination 79 + L264M, V261I, K500E, R308G, I148K, E391Y, E523K, E482K, D492H, E142K, D189K, E537K, D521K |
| 88 | Combination 79 + L264, V261A, K500E, R308G, I148K, E391Y, E523K, E482K, D492H, E142K, D189K, E537K, D521K |
| 89 | Combination 79 + L264, V261V, K500E, R308G, I148K, E391Y, E523K, E482K, D492H, E142K, D189K, E537K, D521K |
| 90 | Combination 79 + L264, V261I, K500E, R308G, I148K, E391Y, E523K, E482K, D492H, E142K, D189K, E537K, D521K |
| 91 | Combination 62 + loop B103, N term his |
| 92 | Combination 62 + loop Chimera, N term His |
| 93 | Combination 79 + L264H, V261A, K500E, R308G, S22A, I148K, E391Y, E523K, E482K, D492H, E142K, D189K, E537K, D521K, |
| 94 | Combination 79 + L264H, V261A, K500E, R308G, D341T, I148K, E391Y, E523K, E482K, D492H, E142K, D189K, E537K, D521K |
| 95 | Combination 79 + L264H, V261A, K500E, R308G, D337G, I148K, E391Y, E523K, E482K, D492H, E142K, D189K, E537K, D521K |
| 96 | Combination 79 + L264H, V261A, K500E, R308G, E60L, I148K, E391Y, E523K, E482K, D492H, E142K, D189K, E537K, D521K |
| 97 | Combination 79 + L264H, V261A, K500E, R308G, E85P, I148K, E391Y, E523K, E482K, D492H, E142K, D189K, E537K, D521K |
| 98 | Combination 79 + L264H, V261A, K500E, R308G, S22A, D341T, D337G, I148K, E391Y, E523K, E482K, D492H, E142K, D189K, E537K, D521K |
| 99 | Combination 79 + L264H, V261A, K500, R308G, I148K, E391Y, E523K, E482K, D492H, E142K, D189K, E537K, D521K |
| 100 | Combination 79 + L264H, V261A, K500E, R308,I148K, E391Y, E523K, E482K, D492H, E142K, D189K, E537K, D521K |
| 101 | Combination 79 + L264H, V261A, K500E, R308G, I148, E391Y, E523K, E482K, D492H, E142K, D189K, E537K, D521K |
| 102 | Combination 79 + L264H, V261A, K500E, R308G, I148K, E391Y, E523K, E482, D492H, E142K, D189K, E537K, D521K |
| 103 | Combination 79 + L264H, V261A, K500E, R308G, I148K, E391Y, E523K, E482K, D492, E142K, D189K, E537K, D521K |
| 104 | Combination 79 + L264H, V261A, K500E, R308G, I148K, E391Y, E523K, E482K, D492H, E142K, D189K, E537K, D521 |
| 105 | Combination 79 + L264H, V261A, K500E, R308G, I148K, E391W, E523K, E482K, D492H, E142K, D189K, E537K, D521K |
| 106 | Combination 79 + L264H, V261A, K500E, R308G, I148K, E391Y, E523Y, E482K, D492H, E142K, D189K, E537K, D521K |
| 107 | Combination 79 + L264H, V261A, K500E, R308G, I148K, E391W, E523Y, E482K, D492H, E142K, D189K, E537K, D521K |
| 108 | Combination 79 + I384F, L264H, V261A, K500E, R308G, I148K, E391Y, E523K, E482K, D492H, E142K, D189K, E537K, D521K |
| 109 | Combination 79 + I384S, L264H, V261A, K500E, R308G, I148K, E391Y, E523K, E482K, D492H, E142K, D189K, E537K, D521K |
| 110 | L264H, V261, K500E, R308G, I148K, E391Y, E523K, E482K, D492H, E142K, D189K, E537K, D521K |
| 111 | L264H, V261I, K500E, R308G, I148K, E391Y, E523K, E482K, D492H, E142K, D189K, E537K, D521K |
| 112 | L264A, V261A, K500E, R308G, I148K, E391Y, E523K, E482K, D492H, E142K, D189K, E537K, D521K |
| 113 | L264A, V261V, K500E, R308G, I148K, E391Y, E523K, E482K, D492H, E142K, D189K, E537K, D521K |
| 114 | L264A, V261I, K500E, R308G, I148K, E391Y, E523K, E482K, D492H, E142K, D189K, E537K, D521K |

TABLE 7-continued

Exemplary modification combinations - positions corresponding to SEQ ID NO: 2.

| Comb. No. | Description |
|---|---|
| 115 | L264M, V261A, K500E, R308G, I148K, E391Y, E523K, E482K, D492H, E142K, D189K, E537K, D521K |
| 116 | L264M, V261V, K500E, R308G, I148K, E391Y, E523K, E482K, D492H, E142K, D189K, E537K, D521K |
| 117 | L264M, V261I, K500E, R308G, I148K, E391Y, E523K, E482K, D492H, E142K, D189K, E537K, D521K |
| 118 | L264, V261A, K500E, R308G, I148K, E391Y, E523K, E482K, D492H, E142K, D189K, E537K, D521K |
| 119 | L264, V261V, K500E, R308G, I148K, E391Y, E523K, E482K, D492H, E142K, D189K, E537K, D521K |
| 120 | L264, V261I, K500E, R308G, I148K, E391Y, E523K, E482K, D492H, E142K, D189K, E537K, D521K |
| 121 | L264H, V261A, K500E, R308G, S22A, I148K, E391Y, E523K, E482K, D492H, E142K, D189K, E537K, D521K, |
| 122 | L264H, V261A, K500E, R308G, D341T, I148K, E391Y, E523K, E482K, D492H, E142K, D189K, E537K, D521K |
| 123 | L264H, V261A, K500E, R308G, D337G, I148K, E391Y, E523K, E482K, D492H, E142K, D189K, E537K, D521K |
| 124 | L264H, V261A, K500E, R308G, E60L, I148K, E391Y, E523K, E482K, D492H, E142K, D189K, E537K, D521K |
| 125 | L264H, V261A, K500E, R308G, E85P, I148K, E391Y, E523K, E482K, D492H, E142K, D189K, E537K, D521K |
| 126 | L264H, V261A, K500E, R308G, S22A, D341T, D337G, I148K, E391Y, E523K, E482K, D492H, E142K, D189K, E537K, D521K |
| 127 | L264H, V261A, K500, R308G, I148K, E391Y, E523K, E482K, D492H, E142K, D189K, E537K, D521K |
| 128 | L264H, V261A, K500E, R308, I148K, E391Y, E523K, E482K, D492H, E142K, D189K, E537K, D521K |
| 129 | L264H, V261A, K500E, R308G, I148, E391Y, E523K, E482K, D492H, E142K, D189K, E537K, D521K |
| 130 | L264H, V261A, K500E, R308G, I148K, E391Y, E523K, E482, D492H, E142K, D189K, E537K, D521K |
| 131 | L264H, V261A, K500E, R308G, I148K, E391Y, E523K, E482K, D492, E142K, D189K, E537K, D521K |
| 132 | L264H, V261A, K500E, R308G, I148K, E391Y, E523K, E482K, D492H, E142K, D189K, E537K, D521 |
| 133 | L264H, V261, K500E, R308G, E60L, I148K, E391Y, E523K, E482K, D492H, E142K, D189K, E537K, D521K |
| 134 | L264H, V261I, K500E, R308G, E60L, I148K, E391Y, E523K, E482K, D492H, E142K, D189K, E537K, D521K |
| 135 | L264A, V261A, K500E, R308G, E60L, I148K, E391Y, E523K, E482K, D492H, E142K, D189K, E537K, D521K |
| 136 | L264A, V261V, K500E, R308G, E60L, I148K, E391Y, E523K, E482K, D492H, E142K, D189K, E537K, D521K |
| 137 | L264A, V261I, K500E, R308G, E60L, I148K, E391Y, E523K, E482K, D492H, E142K, D189K, E537K, D521K |
| 138 | L264M, V261A, K500E, R308G, E60L, I148K, E391Y, E523K, E482K, D492H, E142K, D189K, E537K, D521K |
| 139 | L264M, V261V, K500E, R308G, E60L, I148K, E391Y, E523K, E482K, D492H, E142K, D189K, E537K, D521K |
| 140 | L264M, V261I, K500E, R308G, E60L, I148K, E391Y, E523K, E482K, D492H, E142K, D189K, E537K, D521K |
| 141 | L264, V261A, K500E, R308G, E60L, I148K, E391Y, E523K, E482K, D492H, E142K, D189K, E537K, D521K |
| 142 | L264, V261V, K500E, R308G, E60L, I148K, E391Y, E523K, E482K, D492H, E142K, D189K, E537K, D521K |
| 143 | L264, V261I, K500E, R308G, E60L, I148K, E391Y, E523K, E482K, D492H, E142K, D189K, E537K, D521K |
| 144 | L264H, V261A, K500E, R308G,E60L, S22A, I148K, E391Y, E523K, E482K, D492H, E142K, D189K, E537K, D521K, |
| 145 | L264H, V261A, K500E, R308G, E60L, D341T, I148K, E391Y, E523K, E482K, D492H, E142K, D189K, E537K, D521K |
| 146 | L264H, V261A, K500E, R308G, E60L, D337G, I148K, E391Y, E523K, E482K, D492H, E142K, D189K, E537K, D521K |
| 147 | L264H, V261A, K500E, R308G, E60L, I148K, E391Y, E523K, E482K, D492H, E142K, D189K, E537K, D521K |
| 148 | L264H, V261A, K500E, R308G, E60L, E85P, I148K, E391Y, E523K, E482K, D492H, E142K, D189K, E537K, D521K |
| 149 | K4R, L264H, V261A, K500E, R308G, E60L, I148K, E391Y, E523K, E482K, D492H, E142K, D189K, E537K, D521K |
| 150 | Q513D, L264H, V261A, K500E, R308G, E60L, I148K, E391Y, E523K, E482K, D492H, E142K, D189K, E537K, D521K |
| 151 | D232K, L264H, V261A, K500E, R308G, E60L, I148K, E391Y, E523K, E482K, D492H, E142K, D189K, E537K, D521K |

TABLE 7-continued

Exemplary modification combinations - positions corresponding to SEQ ID NO: 2.

| Comb. No. | Description |
|---|---|
| 152 | L264H, V261A, E60L, K500, R308G, I148K, E391Y, E523K, E482K, D492H, E142K, D189K, E537K, D521K |
| 153 | L264H, V261A, K500E, R308, E60L, I148K, E391Y, E523K, E482K, D492H, E142K, D189K, E537K, D521K |
| 154 | L264H, V261A, K500E, R308G, E60L, I148, E391Y, E523K, E482K, D492H, E142K, D189K, E537K, D521K |
| 155 | L264H, V261A, K500E, R308G, E60L, I148K, E391Y, E523K,E482,D492H, E142K, D189K, E537K, D521K |
| 156 | L264H, V261A, K500E, R308G, E60L, I148K, E391Y, E523K, E482K,D492,E142K, D189K, E537K, D521K |
| 157 | L264H, V261A, K500E, R308G, E60L, I148K, E391Y, E523K, E482K, D492H, E142K, D189K, E537K,D521 |
| 158 | L264H, V261A, K500E, R308G, E60L, I148K, E391W, E523K, E482K, D492H, E142K, D189K, E537K, D521K |
| 159 | L264H, V261A, K500E, R308G, E60L, I148K, E391Y, E523Y, E482K, D492H, E142K, D189K, E537K, D521K |
| 160 | L264H, V261A, K500E, R308G, E60L, I148K, E391W, E523Y, E482K, D492H, E142K, D189K, E537K, D521K |
| 161 | I384F, L264H, V261A, K500E, R308G, E60L, I148K, E391Y, E523K, E482K, D492H, E142K, D189K, E537K, D521K |
| 162 | I384S, L264H, V261A, K500E, R308G, E60L, I148K, E391Y, E523K, E482K, D492H, E142K, D189K, E537K, D521K |
| 163 | L264H, V261A, K500E, R308G, E60L, I148K, E391Y, E523K, E482K, D492H, E142K, D189K, E537K, D521K + T568D, M569T |
| 164 | L264H, V261A, K500E, R308G, E60L, I148K, E391Y, E523K, E482K, D492H, E142K, D189K, E537K, D521K + T568D, M569V |
| 165 | L264H, V261A, K500E, R308G, E60L, I148K, E391Y, E523K, E482K, D492H, E142K, D189K, E537K, D521K + P556A |
| 166 | L264H, V261A, K500E, R308G, E60L, I148K, E391Y, E523K, E482K, D492H, E142K, D189K, E537K, D521K + E65S |
| 167 | L264H, V261A, K500E, R308G, E60L, I148K, E391Y, E523K, E482K, D492H, E142K, D189K, E537K, D521K + E436R |
| 168 | L264H, V261A, K500E, R308G, E60L, I148K, E391Y, E523K, E482K, D492H, E142K, D189K, E537K, D521K + W452Y |
| 169 | L264H, V261A, K500E, R308G, E60L, I148K, E391Y, E523K, E482K, D492H, E142K, D189K, E537K, D521K + Y455W |
| 170 | L264H, V261A, K500E, R308G, E60L, I148K, E391Y, E523K, E482K, D492H, E142K, D189K, E537K, D521K + W452Y, Y455W |
| 171 | L264H, V261A, K500E, R308G, E60L, I148K, E391Y, E523K, E482K, D492H, E142K, D189K, E537K, D521K + L437Y |
| 172 | L264H, V261A, K500E, R308G, E60L, I148K, E391Y, E523K, E482K, D492H, E142K, D189K, E537K, D521K + L437E |
| 173 | L264H, V261A, K500E, R308G, E60L, I148K, E391Y, E523K, E482K, D492H, E142K, D189K, E537K, D521K + S503A |
| 174 | L264H, V261A, K500E, R308G, E60L, I148K, E391Y, E523K, E482K, D492H, E142K, D189K, E537K, D521K + G453A |
| 175 | L264H, V261A, K500E, R308G, E60L, I148K, E391Y, E523K, E482K, D492H, E142K, D189K, E537K, D521K+ Y133L |
| 176 | L264H, V261A, K500E, R308G, E60L, I148K, E391Y, E523K, E482K, D492H, E142K, D189K, E537K, D521K + S267A |
| 177 | L264H, V261A, K500E, R308G, E60L, I148K, E391Y, E523K, E482K, D492H, E142K, D189K, E537K, D521K + L555K |
| 178 | H264A, A261I, K500E, R308G, E60L, I148K, E391W, K523Y, E482K, D492H, E142K, D189K, E537K, D521K |
| 179 | Combination 160 + Y133L |
| 180 | Combination 160 + S267A |
| 181 | Combination 160 + H492D |
| 182 | Combination 160 + A261V |
| 183 | Combination 160 + W452Y, Y455W |
| 184 | Combination 160 + Y133L, S267A |
| 185 | Combination 160 + Y133L, H492D |
| 186 | Combination 160 + Y133L, A261V |
| 187 | Combination 160 + Y133L, W452Y, Y455W |
| 188 | Combination 160 + S267A, H492D |
| 189 | Combination 160 + S267A, A261V |
| 190 | Combination 160 + S267A, W452Y, Y455W |
| 191 | Combination 160 + H492D, A261V |
| 192 | Combination 160 + H492D, W452Y, Y455W |
| 193 | Combination 160 + A261V, W452Y, Y455W |
| 194 | Combination 160 + Y133L, S267A, H492D |
| 195 | Combination 160 + Y133L, S267A, A261V |
| 196 | Combination 160 + Y133L, S267A, W452Y, Y455W |
| 197 | Combination 160 + Y133L, H492D, A261V |
| 198 | Combination 160 + Y133L, H492D, W452Y, Y455W |
| 199 | Combination 160 + Y133L, A261V, W452Y, Y455W |

TABLE 7-continued

Exemplary modification combinations - positions corresponding to SEQ ID NO: 2.

| Comb. No. | Description |
|---|---|
| 200 | Combination 160 + S267A, H492D, A261V |
| 201 | Combination 160 + S267A, H492D, W452Y, Y455W |
| 202 | Combination 160 + S267A, A261V, W452Y, Y455W |
| 203 | Combination 160 + H492D, A261V, W452Y, Y455W |
| 204 | Combination 160 + Y133L, S267A, H492D, A261V |
| 205 | Combination 160 + Y133L, S267A, H492D, W452Y, Y455W |
| 206 | Combination 160 + Y133L, S267A, A261V, W452Y, Y455W |
| 207 | Combination 160 + Y133L, H492D, A261V, W452Y, Y455W |
| 208 | Combination 160 + S267A, H492D, A261V, W452Y, Y455W |
| 209 | Combination 160 + Y133L, S267A, H492D, A261V, W452Y, Y455W |
| 210 | Combination 160 + A261L |
| 211 | Combination 160 + H492K |
| 212 | Combination 160 + H492A |
| 213 | Combination 160 + H492S |
| 214 | Combination 160 + G308R |
| 215 | Combination 160 + I384F |
| 216 | Combination 160 + I384S |
| 217 | Combination 160 + H264A, A261L |
| 218 | Combination 160 + H264A, A261V |
| 219 | Combination 178 + Y133L |
| 220 | Combination 178 + S267A |
| 221 | Combination 178 + H492D |
| 222 | Combination 178 + W452Y, Y455W |
| 223 | Combination 178 + Y133L, S267A |
| 224 | Combination 178 + Y133L, H492D |
| 225 | Combination 178 + Y133L, W452Y, Y455W |
| 226 | Combination 178 + S267A, H492D |
| 227 | Combination 178 + S267A, W452Y, Y455W |
| 228 | Combination 178 + H492D, W452Y, Y455W |
| 229 | Combination 178 + Y133L, S267A, H492D |
| 230 | Combination 178 + Y133L, S267A, W452Y, Y455W |
| 231 | Combination 178 + Y133L, H492D, W452Y, Y455W |
| 232 | Combination 178 + S267A, H492D, W452Y, Y455W |
| 233 | Combination 178 + Y133L, S267A, H492D, W452Y, Y455W |
| 234 | Combination 178 + I261L |
| 235 | Combination 178 + H492K |
| 236 | Combination 178 + H492A |
| 237 | Combination 178 + H492S |
| 238 | Combination 178 + G308R |
| 239 | Combination 178 + I384F |
| 240 | Combination 178 + I384S |
| 241 | Combination 178 + I261V |
| 242 | Combination 160 + D425N |
| 243 | Combination 160 + R429G |
| 244 | Combination 160 + D425N, R429G |
| 245 | Combination 160 + M95T |
| 246 | Combination 160 + R534K |
| 247 | Combination 160 + K142Q |
| 248 | Combination 160 + N145K |
| 249 | Combination 160 + E139K |
| 250 | Combination 160 + E139Q |
| 251 | Combination 160 + Q206R |
| 252 | Combination 160 + Q206K |
| 253 | Combination 160 + N467R |
| 254 | Combination 160 + Q323G |
| 255 | Combination 160 + D414V |
| 256 | Combination 160 + Q317R |
| 257 | Combination 160 + S319R |
| 258 | Combination 160 + I322K |
| 259 | Combination 160 + Q323G |
| 260 | Combination 160 + Q317R, S319R, I322K, Q323G |
| 261 | Combination 160 + V443T, T450A, W452Y, Y455W |
| 262 | Combination 160 + V443T, L445M, A446G, S447V, V449I |
| 263 | Combination 160 + E545K |
| 264 | Combination 160 + F465Y |
| 265 | Combination 160 + Y523W |
| 266 | Combination 160 + K189R |
| 267 | Combination 160 + K142R |
| 268 | Combination 160 + K495R |
| 269 | Combination 160 + E385Y |
| 270 | Combination 160 + D374G |
| 271 | Combination 160 + D533A |
| 272 | Combination 160 + K521R |

II. Compositions and Kits Comprising a Modified Recombinant Enzyme

In some aspects, the disclosure relates to compositions comprising a modified polymerase described herein. In some embodiments, a composition comprises a plurality of modified polymerases. In some embodiments, the composition further comprises a salt and/or buffer.

In some aspects, the disclosure relates to kits comprising a modified polymerase described herein. In some embodiments, a kit comprises a plurality of modified polymerases. Kits optionally may provide additional components such as buffers and interpretive information. Normally, the kit comprises a container and a label or package insert(s) on or associated with the container. In some embodiment, the disclosure provides articles of manufacture comprising contents of the kits described above. Suitable packaging includes, but is not limited to, vials, bottles, jars, flexible packaging, and the like. In some embodiments, the kit further comprises a container, a salt, and/or a buffer.

III. Methods of Producing a Modified Recombinant Enzyme

In some aspects, the disclosure relates to methods of recombinantly producing a modified polymerase described herein. In some embodiments, to express a polymerase of the disclosure, DNA encoding the polymerase is inserted into one or more expression vectors such that the encoded polymerase is operatively linked to transcriptional and translational control sequences (see, e.g., U.S. Pat. No. 6,914,128, the contents of which is incorporated herein by reference). In this context, the term "operatively linked" is intended to mean that a sequence encoding the polymerase is ligated into a vector such that transcriptional and translational control sequences within the vector serve their intended function of regulating the transcription and translation of the polymerase. The expression vector and expression control sequences are chosen to be compatible with the expression host cell used. Polymerase-encoding sequences are inserted into expression vectors by standard methods (e.g., ligation of complementary restriction sites on the polymerase-encoding sequence and vector or blunt end ligation if no restriction sites are present).

For expression of a modified polymerase, an expression vector encoding the modified polymerase can be transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection, and the like. Suitable host cells for expressing a polymerase of the disclosure include prokaryote, yeast, or higher eukaryote cells.

Suitable prokaryotes for this purpose include eubacteria, such as Gram-negative or Gram-positive organisms, e.g., Enterobacteriaceae such as *Escherichia*, e.g., *E. coli*, *Enterobacter*, *Erwinia*, *Klebsiella*, *Proteus*, *Salmonella*, e.g., *Salmonella typhimurium*, *Serratia*, e.g., *Serratia marcescans*, and *Shigella*, as well as *Bacilli* such as *B. subtilis* and *B. licheniformis*, *Pseudomonas* such as *P. aeruginosa*, and *Streptomyces*. In addition to prokaryotes, eukaryotic microbes such as filamentous fungi or yeast are suitable cloning or expression hosts for polypeptide encoding vectors. Saccharomyces cerevisiae, or common baker's yeast, is the most commonly used among lower eukaryotic host microorganisms. However, a number of other genera, species, and strains are commonly available and useful herein, such as *Schizosaccharomyces pombe*; *Kluyveromyces* hosts such as, e.g., *K. lactis*, *K. fragilis*, *K. bulgaricus*, *K. wickeramii*, *K. waltii*, *K. drosophilarum*, *K. thermotolerans*, and *K. marxianus*; *Pichia pastoris*; *Candida*; *Trichoderma reesia*; *Neurospora crassa*; *Schwanniomyces* such as *Schwanniomyces occidentalis*; and filamentous fungi such as, e.g., *Neurospora*, *Penicillium*, *Tolypocladium*, and *Aspergillus* hosts such as *A. nidulans* and *A. niger*.

In some embodiments, host cells are transformed with the above-described expression or cloning vectors for polymerase production and cultured in conventional nutrient media modified as appropriate for inducing promoters, selecting transformants, or amplifying the genes encoding the desired sequences. The host cells used to produce a polymerase may be cultured in a variety of media. Commercially available media such as Ham's F10™ (Sigma), Minimal Essential Medium™ (MEM), (Sigma), RPMI-1640 (Sigma), and Dulbecco's Modified Eagle's Medium™ (DMEM), (Sigma) are suitable for culturing the host cells. The culture conditions, such as temperature, pH, and the like, are those previously used with the host cell selected for expression, and will be apparent to the ordinarily skilled artisan.

In some embodiments, a polymerase variant can be produced intracellularly, in the periplasmic space, or directly secreted into the medium of a cell. In embodiments where the polymerase variant is produced intracellularly, the particulate debris, either host cells or lysed cells (e.g., resulting from homogenization), can be removed by a variety of means, including but not limited to, by centrifugation or ultrafiltration. Where the polymerase is secreted into the medium, supernatants from such expression systems can be first concentrated using a commercially available protein concentration filter, which can then be subjected to one or more additional purification techniques, including but not limited to affinity chromatography, including protein affinity chromatography, ion exchange chromatography, such as anion or cation exchange chromatography, and hydrophobic interaction chromatography.

In some embodiments, a modified polymerase comprises one or more unnatural amino acid substitutions. As used herein, an "unnatural amino acid" refers to any amino acid, modified amino acid, or amino acid analogue other than the following twenty genetically encoded alpha-amino acids: alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, valine. In some embodiments, unnatural amino acids may include naturally occurring compounds other than the twenty alpha-amino acids above. Unnatural amino acids and methods of incorporating unnatural amino acids into protein sequences are known in the art, for example, as described in U.S. Pat. No. 7,045,337, the contents of which are incorporated herein by reference.

IV. Methods of Using a Modified Recombinant Enzyme

In some embodiments, the disclosure provides modified recombinant enzymes and compositions which may be used for conducting in vitro polymerization reactions. In some embodiments, modified recombinant DNA polymerases provided by the disclosure may be used for in vitro reactions related to the manipulation of DNA (e.g., DNA sequencing).

Among other aspects, the disclosure provides modified recombinant enzymes (e.g., polymerases) that may be used to conduct in vitro polymerization reactions. In some embodiments, polymerases described herein comprise one or more modifications which—individually or in combination—are useful to conduct a sequencing reaction. In some embodiments, one or more of the modifications described herein can be utilized to produce a polymerase having one or more properties useful for conducting sequencing reactions, e.g., properties such as polymerase processivity, fidelity (e.g., accuracy), substrate (e.g., nucleoside polyphosphate) binding affinity, substrate utilization (e.g., the rate at which nucleoside polyphosphates are incorporated into a growing strand complementary to a template strand), polymerase interactions with modified substrates (e.g., labeled nucleoside polyphosphates), or some combination thereof. In some embodiments, one or more of the modifications minimize or eliminate proofreading capability of the polymerase. For example, in some embodiments, one or more modifications may be made to an exonuclease domain of a polymerase that effects a loss in exonuclease activity of the polymerase.

In some aspects, the application relates to modified polymerases having altered biochemical properties that are advantageous for single molecule nucleic acid sequencing technologies. In some embodiments, variant polymerases described herein have been modified to provide improved signal readout in single molecule sequencing reactions. FIG. 1 provides an example illustration of the progression of a sequencing reaction in relation to the real-time signal readout. Without wishing to be bound by theory, it is thought that some single molecule nucleic acid sequencing reactions proceed in accordance with scheme 100.

At the start of a reaction (panel I), a polymerase (dashed line) is confined in an observation region and is bound to a template strand and a primer strand. As shown, different types of nucleotides (e.g., A, G, T, C, U), each having different types of detectable labels, are present in the same reaction mixture. When the polymerase associates with a luminescently labeled nucleotide (panel II), the label becomes confined in the observation region for a period of time. During an incorporation event, for example, this period of time can be sufficient for the label to receive and/or emit energy in an amount sufficient to detect and identify its presence in the observation region. As illustrated by panels I and II of scheme 100 in relation to signal readout 102, an incorporation event can be associated with a signal pulse for a period of time corresponding to pulse width, pw.

It should be appreciated that, in some embodiments, an individual signal pulse associated with an incorporation event can be affected by a variety of conditions, such as the type of nucleotide being incorporated or the activity of the polymerase at a specific point in time. In some embodiments, an individual signal pulse can have an individual pulse width of between about 10 milliseconds and about 10 seconds. Accordingly, in some embodiments, individual pulse widths may be averaged to provide a parameter for comparative purposes. As used herein, in some embodiments, "pulse width" refers to a value corresponding to an average of a plurality of individual signal pulses, each individual signal pulse having an individual pulse width.

In some embodiments, modified polymerizing enzymes of the present application produce pulse widths of between about 10 milliseconds and about 10 seconds. In some embodiments, pulse width is at least 10 milliseconds and up to 10 seconds, at least 10 milliseconds and up to 5 seconds, at least 10 milliseconds and up to 1 second, or between about 10 milliseconds and about 1 second. In some embodiments, pulse width is between about 10 and about 500 milliseconds, between about 10 and about 200 milliseconds, between about 10 and about 100 milliseconds, between about 10 and about 50 milliseconds, between about 50 milliseconds and about 1 second, between about 50 and about 500 milliseconds, between about 50 and about 200 milliseconds, between about 50 and about 100 milliseconds, between about 100 milliseconds and about 1 second, between about 100 and about 500 milliseconds, between about 100 and about 200 milliseconds, between about 200 milliseconds and about 1 second, between about 200 and about 500 milliseconds, or between about 500 milliseconds and about 1 second.

Following incorporation of the nucleotide into the growing strand and cleavage of the luminescent label, the label diffuses out of the illumination volume and is no longer detectable in the observation region (panel III). Also as illustrated in panel III, following an incorporation event, the polymerase progresses along the template strand such that it is capable of associating with a subsequent luminescently labeled nucleotide. Similar to the progression from panel I to panel II, the signal corresponding to the progression from panel III to panel IV in signal trace 102 increases in intensity from a relatively low intensity level to a signal pulse indicative of an association event. In terms of signal trace 102, the period of time between an incorporation event and a subsequent association event can be associated with an interpulse distance, ipd.

As detailed in the foregoing with respect to pulse width, in some embodiments, an individual interpulse distance associated with a period of time between a first and second signal pulse can be affected by a variety of conditions, such as the activity or processivity of the polymerase at a specific point in time. In some embodiments, an individual interpulse distance corresponds to a period of between about 10 milliseconds and about 1 minute or longer (e.g., between about 1 and about 60 seconds, between about 1 and about 30 seconds, between about 1 and about 20 seconds, between about 1 and about 10 seconds, or less than about 1 second). Accordingly, in some embodiments, individual interpulse distances may be averaged to provide a parameter for comparative purposes. As used herein, in some embodiments, "interpulse distance" refers to a value corresponding to an average of a plurality of individual interpulse distances.

In some embodiments, modified polymerizing enzymes of the present application produce interpulse distances of between about 10 milliseconds and about 10 seconds. In some embodiments, interpulse distance is at least 10 milliseconds and up to 10 seconds, at least 10 milliseconds and up to 5 seconds, at least 10 milliseconds and up to 1 second, or between about 10 milliseconds and about 1 second. In some embodiments, interpulse distance is between about 10 and about 500 milliseconds, between about 10 and about 200 milliseconds, between about 10 and about 100 milliseconds, between about 10 and about 50 milliseconds, between about 50 milliseconds and about 1 second, between about 50 and about 500 milliseconds, between about 50 and about 200 milliseconds, between about 50 and about 100 milliseconds, between about 100 milliseconds and about 1 second, between about 100 and about 500 milliseconds, between about 100 and about 200 milliseconds, between about 200 milliseconds and about 1 second, between about 200 and about 500 milliseconds, or between about 500 milliseconds and about 1 second.

Characteristics of a pulse width and/or an interpulse distance, in some embodiments, can be used to identify a specific luminescent label. In some embodiments, modified polymerases of the disclosure can be used in a sequencing reaction by observing a series of pulse widths indicative of the association of luminescently labeled nucleotides to determine a nucleotide sequence of a template strand. In some embodiments, artefacts in this process can give rise to incorrect sequencing information. For example, panel V illustrates a bind-and-release event in which a luminescently labeled nucleotide is confined in the observation region for a period of time sufficient to give rise to a signal pulse, but without an incorporation event.

As shown in panel V, following the detected incorporation in panel IV, the cleaved luminescent label diffuses out of the observable region (i). A further luminescently labeled nucleotide associates with the polymerase in the observable region to give rise to a detectable signal (ii). Rather than being incorporated into the growing strand, the luminescently labeled nucleotide dissociates from the polymerase and diffuses back into the reaction mixture (iii). As such, following a subsequently successful incorporation of the same type of nucleotide (not shown), the signal pulse corresponding to panel V would result in an apparent insertion in sequencing information readout. Accordingly, in some embodiments, modified recombinant enzymes of the present application have pulse widths of sufficient length to discern true incorporation events from these and other such artefact events. In some embodiments, modified recombinant enzymes of the present application have one or more modifications that decrease the probability of premature substrate release from a polymerase active site. In some embodiments, modified recombinant enzymes of the present application have one or more modifications that increase the probability of substrate incorporation once a substrate is associated with a polymerase active site.

In some embodiments, aspects of the present application can be used in methods related to assays of biological samples. In exemplary embodiments, methods provided herein are useful in techniques used to determine the sequence of one or more nucleic acids or polypeptides in the sample and/or to determine the presence or absence of one or more nucleic acid or polypeptide variants (e.g., one or more mutations in a gene of interest) in the sample. In some embodiments, tests can be performed on patient samples (e.g., human patient samples) to provide nucleic acid sequence information or to determine the presence or absence of one or more nucleic acids of interest for diagnostic, prognostic, and/or therapeutic purposes. In some examples, diagnostic tests can include sequencing a nucleic acid molecule in a biological sample of a subject, for example by sequencing cell free DNA molecules and/or expression products (e.g., RNA) in a biological sample of the subject. For example, the present disclosure provides methods and compositions that may be advantageously utilized in the technologies described in co-pending U.S. patent application Ser. Nos.: 14/543,865, 14/543,867, 14/543,888, 14/821,656, 14/821,686, 14/821,688, 15/161,067, 15/161,088, 15/161,125, 15/255,245, 15/255,303, 15/255,624, 15/261,697, 15/261,724, 62/289,019, 62/296,546, 62/310,398, 62/339,790, 62/343,997, 62/344,123, and 62/426,144, the contents of each of which are incorporated herein by reference.

Some aspects of the application are useful in techniques capable of sequencing biological polymers, such as nucleic acids and proteins. In some embodiments, methods and compositions described in the application can be used in techniques that identify a series of nucleotide or amino acid monomers that are incorporated into a nucleic acid or protein (e.g., by detecting a time-course of incorporation of a series of labeled nucleotide or amino acid monomers). In some embodiments, methods and compositions described in the application can be incorporated into techniques that identify a series of nucleotides that are incorporated into a template-dependent nucleic acid sequencing reaction product synthesized by a polymerizing enzyme.

During sequencing, a polymerizing enzyme may couple (e.g., attach) to a priming location of a target nucleic acid molecule (e.g., a nucleic acid molecule of a sequencing template). The priming location can comprise a primer that is complementary to a portion of the target nucleic acid molecule. As an alternative the priming location is a gap or nick that is provided within a double stranded segment of the target nucleic acid molecule. A gap or nick can be from 0 to at least 1, 2, 3, 4, 5, 6, 7, 8, 9, 10, 20, 30, or 40 nucleotides in length. A nick can provide a break in one strand of a double stranded sequence, which can provide a priming location for a polymerizing enzyme, such as, for example, a strand displacing polymerase enzyme.

In some cases, a sequencing primer can be annealed to a target nucleic acid molecule that may or may not be immobilized to a solid support. A solid support can comprise, for example, a sample well on an integrated device used for nucleic acid sequencing. In some embodiments, a sequencing primer may be immobilized to a solid support and hybridization of the target nucleic acid molecule also immobilizes the target nucleic acid molecule to the solid support. In some embodiments, a polymerase is immobilized to a solid support and soluble primer and target nucleic acid are contacted to the polymerase. However, in some embodiments a complex comprising a polymerase, a target nucleic acid and a primer is formed in solution and the complex is immobilized to a solid support (e.g., via immobilization of the polymerase, primer, and/or target nucleic acid). In some embodiments, none of the components in a sample well are immobilized to a solid support. For example, in some embodiments, a complex comprising a polymerase, a target nucleic acid, and a primer is formed in solution and the complex is not immobilized to a solid support. In some embodiments, a modified recombinant enzyme is immobilized on a surface. In some embodiments, the surface comprises a nanoaperture. In certain embodiments, the nanoaperture comprises a bottom surface comprising a first material and sidewalls formed by a plurality of metal or metal oxide layers. In some embodiments, the first material is a transparent material or glass. In some embodiments, the bottom surface is flat. In some embodiments, the bottom surface is a curved well.

In some embodiments, the bottom surface includes a portion of the sidewalls below the sidewalls formed by a plurality of metal or metal oxide layers. In some embodiments, the first material is fused silica or silicon dioxide. In some embodiments, the plurality of layers each comprise a metal (e.g., Al, Ti) or metal oxide (e.g., $Al_2O_3$, $TiO_2$, TiN). In some embodiments, the surface can be a surface of a chip made from glass or other transparent material, silica, fused silica, silicon dioxide, a polymer, other material, or a combination thereof (e.g., a combination of different layers, for example including one or more metal layers).

Under appropriate conditions, a polymerase enzyme that is contacted to an annealed primer/target nucleic acid can add or incorporate one or more nucleotides onto the primer, and nucleotides can be added to the primer in a 5' to 3', template-dependent fashion. Such incorporation of nucleotides onto a primer (e.g., via the action of a polymerase) can generally be referred to as a primer extension reaction. Each nucleotide can be associated with a detectable tag that can be detected and identified (e.g., based on its luminescent lifetime and/or other characteristics) during the nucleic acid extension reaction and used to determine each nucleotide incorporated into the extended primer and, thus, a sequence of the newly synthesized nucleic acid molecule. Via sequence complementarity of the newly synthesized nucleic acid molecule, the sequence of the target nucleic acid molecule can also be determined. In some cases, annealing of a sequencing primer to a target nucleic acid molecule and incorporation of nucleotides to the sequencing primer can occur at similar reaction conditions (e.g., the same or similar reaction temperature) or at differing reaction conditions (e.g., different reaction temperatures). In some embodiments, sequencing by synthesis methods can include the presence of a population of target nucleic acid molecules (e.g., copies of a target nucleic acid) and/or a step of amplification of the target nucleic acid to achieve a population of target nucleic acids. However, in some embodiments, sequencing by synthesis is used to determine the sequence of a single molecule in each reaction that is being evaluated (and nucleic acid amplification is not required to prepare the target template for sequencing). In some embodiments, a plurality of single molecule sequencing reactions are performed in parallel (e.g., on a single integrated device) according to aspects of the present application. For example, in some embodiments, a plurality of single molecule sequencing reactions are each performed in separate reaction chambers on an integrated device.

In some embodiments, polymerizing enzymes of the disclosure are useful in single molecule sequencing reactions conducted in sample wells of considerably small volumes. For example, the volume of a sample well may be between about $10^{-21}$ liters and about $10^{-15}$ liters, in some implementations. Because the sample well has a small volume, detection of single-sample events (e.g., single-molecule events) are achievable. In some embodiments, a surface (e.g., a surface of a sample well) is configured to receive a polymerase described herein. In some embodiments, a sample well receives a polymerase that may be disposed on a surface of the sample well, such as a bottom surface. In some embodiments, a sample well is formed within an integrated device, wherein the bottom surface of the sample well is distal to the surface of the integrated device into which it is formed.

In certain embodiments, techniques described herein relate to polymerizing enzymes, and complexes thereof, which may be added to a sample well. In some embodiments, polymerizing enzymes described herein may be confined in a target volume of the sample well (e.g., a reaction volume). In some embodiments, the target volume is a region within a sample well. In embodiments when one or more polymerizing enzymes are to be immobilized on the bottom surface, it may be desirable to functionalize the bottom surface to allow for attachment of the one or more polymerizing enzymes (e.g., polymerizing enzymes and complexes thereof). In some embodiments, the bottom surface is functionalized with a material comprising a coupling group. For example, the coupling group may comprise chemical moieties, such as amine groups, carboxyl groups, hydroxyl groups, sulfhydryl groups, metals, chelators, and the like. Alternatively, they may include specific binding elements, such as biotin, bis-biotin, avidin, streptavidin, neutravidin, lectins, SNAP-tags™ or substrates therefore, associative or binding peptides or proteins, antibodies or antibody fragments, nucleic acids or nucleic acid analogs, or the like. Additionally, or alternatively, the coupling group may be used to couple an additional group that is used to couple or bind with a molecule of interest (e.g., a polymerizing enzyme or complex thereof), which may, in some cases include both chemical functional groups and specific binding elements. By way of example, a coupling group, e.g., biotin or bis-biotin, may be deposited upon a substrate surface and selectively activated in a given area. An intermediate binding agent, e.g., streptavidin, may then be coupled to the first coupling group. The molecule of interest (e.g., a polymerizing enzyme or complex thereof), which in this particular example would be biotinylated, is then coupled to the streptavidin. In some embodiments, polymerizing enzymes described herein may further comprises a coupling moiety capable of forming an interaction with a coupling group that immobilizes the polymerase to a surface (e.g., a surface of a sample well). For example, in some embodiments, polymerizing enzymes comprise N-terminal or C-terminal biotinylation or bis-biotinylation sequences capable of binding to an avidin protein. In some embodiments, a biotinylation or bis-biotinylation sequence further comprises a linker sequence. For example, in some embodiments, a C-terminal linker/biotinylation sequence comprises the amino acid sequence GGGSGGGSGGGSGLNDFFEAQKIEWHE (SEQ ID NO: 84:3). In some embodiments, polymerizing enzymes comprise N-terminal or C-terminal his-biotinylation sequences capable of binding to two binding sites of an avidin protein. For example, in some embodiments, an N-terminal or C-terminal linker/bis-biotinylation sequence comprises the amino acid sequence (SEQ ID NO: 844)
GGGGSGGGSGGGSGLNDFFEAQKIEWHEGGGSGGGSGGGSGLNDFFEAQK
IEWHE.

EXAMPLES

Example 1

Expression and Evaluation of Modified Polymerases

Recombinant polymerase variants were expressed in *E. coli* and purified from 150 mL scale cultures using His-spin columns. Protein purity was analyzed by SDS-PAGE followed by Coomassie Blue staining (FIG. 7). Following buffer exchange and protein concentration, the recombinant variants were evaluated for activity and processivity in the presence of dNTPs with trap chase for 30 minutes at 30° C. Chimeric polymerase variants C017 and C020 showed activity, processivity, and length of synthesis in the presence of a trap. Utilization of dNTP analogs by variant polymerases was measured to evaluate suitability of the polymerases in sequencing reactions. Both homologous mutant variants and chimeric polymerase variants displayed utilization of dN6Ps. Results from single molecule sequencing are shown below in TABLE 8.

TABLE 8

Sequencing Results with Modified Polymerases

| Polymerase (Name) | Num. Reads | Read Length | Rate (bases/s) | Local Base Rate (bases/s) | Pulse Width (s) | Interpulse Dist. (s) | Accuracy |
|---|---|---|---|---|---|---|---|
| Q001 | 90890 | 10205 | 1.82 | 2.41 | 0.07 | 0.36 | 80.9% |
| Q020 | 79366 | 7973 | 1.67 | 2.42 | 0.08 | 0.35 | 81.6% |
| Q035 | 96323 | 15532 | 2.05 | 3.04 | 0.13 | 0.21 | 88.7% |
| Q036 | 104352 | 8816 | 1.26 | 2.03 | 0.09 | 0.42 | 84.5% |
| C0138 | 16742 | 3486 | 1.47 | 2.30 | 0.11 | 0.34 | 71.4% |
| C0145 | 3982 | 6287 | 1.52 | 2.66 | 0.10 | 0.29 | 73.0% |
| C0173 | 3360 | 6125 | 1.59 | 2.52 | 0.11 | 0.30 | 70.0% |
| C0186 | 24165 | 11699 | 1.77 | 2.59 | 0.10 | 0.30 | 73.0% |
| C0189 | 60002 | 2880 | 1.77 | 2.47 | 0.11 | 0.32 | 85.2% |
| C0190 | 8729 | 4938 | 1.15 | 1.67 | 0.33 | 0.29 | 86.0% |
| C0239 | 36908 | 11226 | 1.39 | 1.79 | 0.32 | 0.25 | 84.7% |
| C0256 | 17700 | 14200 | 2.21 | 3.18 | 0.11 | 0.22 | 90.3% |
| C0263 | 9440 | 7640 | 1.96 | 2.81 | 0.10 | 0.27 | 84.4% |
| C0266 | 34395 | 10183 | 1.42 | 1.85 | 0.29 | 0.26 | 84.9% |
| C0267 | 811 | 6787 | 1.38 | 1.80 | 0.36 | 0.21 | 88.0% |
| C0268 | 23582 | 6638 | 1.47 | 1.95 | 0.27 | 0.26 | 80.7% |
| C0288 | 40472 | 3763 | 1.22 | 1.77 | 0.33 | 0.24 | 85.0% |
| C0289 | 37754 | 4895 | 1.71 | 2.63 | 0.14 | 0.26 | 85.1% |
| C0290 | 31770 | 4889 | 1.73 | 2.64 | 0.14 | 0.26 | 85.0% |
| C0295 | 36350 | 3110 | 1.48 | 1.99 | 0.21 | 0.31 | 86.1% |
| C0299 | 40027 | 3243 | 1.62 | 2.37 | 0.10 | 0.34 | 83.0% |
| C0303 | 28410 | 5605 | 1.25 | 1.76 | 0.30 | 0.29 | 85.2% |
| C0307 | 23243 | 3013 | 1.31 | 1.93 | 0.23 | 0.30 | 84.3% |
| C0313 | 1890 | 11676 | 1.41 | 1.87 | 0.29 | 0.26 | 81.9% |
| C0320 | 372 | 11679 | 1.53 | 2.09 | 0.27 | 0.22 | 87.5% |
| C0321 | 953 | 12311 | 1.3 | 1.75 | 0.31 | 0.27 | 83.9% |
| C0326 | 23 | 11907 | 2.01 | 2.81 | 0.11 | 0.26 | 77.6% |
| C0327 | 92 | 22355 | 2.12 | 2.93 | 0.09 | 0.27 | 69.5% |
| C0328 | 375 | 12911 | 1.64 | 2.52 | 0.1 | 0.31 | 81% |
| C0329 | 1409 | 19941 | 1.78 | 2.61 | 0.09 | 0.31 | 81.2% |
| C0333 | 828 | 20204 | 1.56 | 2.21 | 0.08 | 0.38 | 76.7% |
| C0334 | 859 | 7597 | 1.19 | 1.8 | 0.32 | 0.26 | 87% |
| C0335 | 664 | 22145 | 2.05 | 3.07 | 0.1 | 0.24 | 83% |
| C0337 | 943 | 16926 | 1.99 | 2.96 | 0.1 | 0.25 | 84% |
| C0338 | 511 | 13170 | 1.37 | 1.86 | 0.3 | 0.25 | 83.8% |
| C0352B | 5269 | 13946 | 1.92 | 2.69 | 0.13 | 0.26 | 84.6% |

Example 2

Modified Polymerases with Improved Substrate Utilization

The *E. faecium* polymerase variant, EFM37, contains three active site substitutions at positions L264, V261, and K500 that were determined to improve utilization of hexaphosphate substrates (dN6Ps). Dumbbell ternary complexes with EFM37, or related variants such as EFM48, were observed to load on sequencing chips and to undergo processive DNA replication both inside sample wells and on the top surface using unlabeled dN6Ps (10 µM) based on nanoball assays (FIGS. 8A-8D). DNA nanoballs were generated by loading sequencing chips with EFM37-dumbbell ternary complexes and 1-hour replication with 10 µM dN6Ps followed by incubation with FAM-labeled oligonucleotide probe.

In subsequent experiments using dye-labeled dN6P substrates containing a duplex DNA linker between dN6P and dye, real-time DNA synthesis was not observed. A real-time stopped-flow assay for short fork strand displacement DNA synthesis was used to further evaluate variants EFM37, EFM48 and EMF66. The real-time stopped-flow strand-displacement DNA synthesis assay utilized a short fork DNA substrate in which primer extension, upon rapid addition of nucleotides and $Mg^{++}$ (10 mM $MgCl_2$) at 30° C., results in strand displacement and unquenching of a FAM-labeled displaced oligonucleotide (FIG. 10A). Based on the assay results, it was determined that DNA synthesis rates were approximately 3-10 times slower in rate (base pairs per second) with the duplex DNA linker analogs compared to the dN6Ps (FIGS. 8C-8D).

It was determined that *E. faecium* has an overall negatively charged surface, including in the vicinity of the polymerase active site, and a relatively low theoretical isoelectric point (pI=5.5). Based on this understanding and other observations, it was hypothesized that electrostatic repulsion between the negatively charged nucleotide analog and the *E. faecium* polymerase surface contributed to the poor utilization of these analogs.

The wild-type *E. faecium* structure was computationally modeled, and surface positions in the vicinity of the active site were identified for introduction of substitutions to make this region more electropositive, and therefore more attractive to negatively charged analogs, including DNA-linker analogs, while minimally affecting structural stability. A depiction of the modeled structure is shown in FIG. 9A, with negatively charged residues shown colored, and the location of catalytic aspartate residues in the polymerase active site indicated by an arrow. The polymerase homology domains map to regions of the *E. faecium* polypeptide as shown in FIG. 9B, which is oriented in an N-terminal to C-terminal fashion with start position of each domain indicated. A total of 12 substitutions affecting surface charge were designed, including nine negative-to-positive substitutions, and multiple combinations of these were screened for dN6P and DNA linker analog utilization in two rounds of screening.

All *E. faecium* variants screened contained the same three active site mutations as the parent enzyme EFM37 (L264H, V261A, K500E), and EFM37 was purified and screened by stopped-flow strand-displacement synthesis assays in parallel as a reference from which to identify improvements in rate. After two rounds of screening, two related variants—EFM88 and EFM89—were identified with major increases in incorporation rate with both dN6Ps (2.0-2.7-fold) and DNA-linker analogs (6.3-8.7-fold) relative to EFM37 (FIG. 10A). EFM88 and EFM89 both contain nine surface charge substitutions, seven of which are in common, and a total of 13 substitutions relative to wild-type. These changes result in the net elimination of seven negative charges and addition of five positive charges (FIG. 10B) in the region surrounding the entrance to the polymerase active site, resulting in a major remodeling of the electrostatic surface in this area. A comparison between the modeled wild-type and EFM88 electrostatic surfaces is shown in FIG. 10C.

The EFM88 and EFM89 variants were evaluated in single-molecule sequencing reactions using DNA linker analog substrates. Ternary complexes containing EFM88 or EFM89 were generated with primed M13 plasmid DNA and loaded onto sequencing chips. Upon initiation of sequencing reactions with buffer containing dye-labeled DNA-linker analogs, pulsing characteristic of nucleotide incorporation was observed, and sequencing alignments to the M13 reference sequence were obtained in the range of 67-82% accuracy using data collected with an avalanche photodiode instrument. Results are shown in FIGS. 10D-10F. An example alignment with EFM89 is also shown in FIG. 11.

To further evaluate these findings, ternary complexes (2 kb template DNA derived by PCR from lambda phage) made with EFM89 from two independent expression and purification batches were evaluated in further sequencing reactions using a commercial platform. Both batches of EFM89 displayed consistent sequencing results (FIGS. 12A-12D), with 74-76% accuracy and an approximate 3 kb read length.

Example 3

Modified Recombinant Enzymes with Improved Stability

Due to the destabilizing effect of a high level of substitutions (13 total), EFM88 and EFM89 display lower purification yield and active fraction than wild-type *E. faecium* polymerase, and low loading and short read length in single-molecule sequencing.

Using rational design principles and computational tools, three panels of EFM89-based variants were designed containing substitutions to improve stability: 1. reversions or substitutions in the polymerase active site (EFM144-154); 2. novel stability substitutions in the exonuclease domain or TPR1 sub-domain (EFM155-160); and 3. reversions at six residues located on the polymerase surface (EFM161-166). With these panels, an automated small-scale purification workflow for EFMs optimized for on-chip screening was used. Miniaturization of the EFM process involved modification and optimization of a number of steps, including use of tube cultures, in-lysate streptavidin complexing, and one-step purification with low stringency buffers compatible with EFMs. This method produced high yield for wild-type *E. faecium* polymerase and sufficient yield for on-chip screening for a number of candidates (FIG. 16).

EFM158, containing the single substitution E60L (relative to EFM158), displayed remarkably higher yield in this method (FIG. 16). This increase in yield indicates that introduction of E60L results in a major improvement in protein stability.

*E. faecium* polymerase contains a glutamate at position 60, whereas all other homologs contain leucine (see the multiple sequence alignment in FIGS. 17A-17K. The strong sequence conservation of leucine at this position is observed even among very distant homologs (<30% identity). This conserved leucine residue is buried in the hydrophobic core of the exonuclease domain. The hydrophobic environment surrounding E60 in an in-house *E. faecium* polymerase crystal structure and L60 in chimera C320 is displayed in FIG. 18.

Multiple EFM variants were tested on a commercial platform using 2 kb templates. Here, in agreement with its dramatic increase in yield, EFM158 displayed major improvements in loading, read length, N50, and percent of wells still active at the end of the 6-hour sequencing run (FIG. 19). Compared to EFM89, read length increased 80% from 3 kb to 5.4 kb. Due to an improved read length distribution (FIG. 20) the N50 read length increased from 4 kb to 8.6 kb with EFM158 (meaning 50% of the data is in reads longer 8.6 kb). The increased read length of EFM158 may be due to increased stability/survivability of the enzyme and/or ternary complex under sequencing conditions, as indicated by a major increase in the percentage of wells that are still actively replicating at the end of the 6-hour run from 0.9% to 12.2%. A comparison of the surface charges of the EFM158 and wild-type *E. faecium* polymerase is provided in FIG. 21.

Example 4

Additional Polymerases Variants

EFM158 provides a much more solid backbone for evolving new EFM candidates with improved sequencing performance. The increased yield and on-chip loading enable improved screening methodology, including automated high-throughput purification and multiplexed single-molecule sequencing.

As such, EFM158 was used as a backbone to screen for additional EFM variants of interest. A number of these EFM variants demonstrated increased accuracy and/or have other effects on sequencing such as interpulse duration (FIG. 22), pulse width, and read length (FIG. 23).

Example 5

Substitutions Enriched in Emulsion-Based IVTT-RCA Screen with EF Polymerase

A gene encoding EF polymerase was subjected to random mutagenesis using mutagenic PCR and sub-cloned into a circular construct suitable for protein expression in an in-vitro transcription and translation (IVTT) expression system followed by rolling-circle replication (IVTT-RCA). The mutagenized EF polymerase library was annealed with a primer for DNA-replication and emulsified into femtoliter-scale droplets using a microfluidic chip (Leman et al. Lab Chip, 2015, 15, 753-765) in a buffer containing IVTT components, dNTPs, and Mg++; emulsification of the library resulted in a single gene per droplet. The emulsion was incubated at 30 degrees for 16 hours. In this manner, the droplet-isolated EF variants were allowed to replicate their own genes by RCA, resulting in enrichment of DNA sequences encoding EF variants containing favorable substitutions that increase their replication capacity; substitutions responsible for increased replication capacity can include improved protein stability and yield, processivity, strand-displacement, DNA-binding, and speed. After IVTT-RCA, the emulsion was broken and replicated DNA was recovered and subjected to PCR with primers designed to recover amplicons containing the full-length genes from the RCA products. The amplicons were subjected to an additional round of IVTT-RCA selection or ligated with hairpin adapters and subjected to high-throughput single-molecule DNA sequencing in order to identify the substitutions present in the recovered genes. The starting library (i.e., before IVTT-RCA selection) was also sequenced to serve as a reference. Enriched substitutions after 2 rounds of IVTT-RCA selection were identified by comparing the relative abundance (fraction of reads containing the substitution) of each substitution in the set of pre- and post-selection sequence reads (FIG. 25).

Embodiments

In some embodiments, the present disclosure provides: 1. A recombinant polymerizing enzyme based on a first polymerizing enzyme selected from Table 1, wherein at least one amino acid segment of the first polymerizing enzyme has been replaced with a corresponding amino acid segment from a second polymerizing enzyme selected from Table 1, wherein the first and second polymerizing enzymes are different, and optionally wherein the recombinant polymerizing enzyme further comprises one or more amino acid insertions, deletions, or substitutions relative to a sequence of the first and/or second polymerizing enzyme of Table 1. In particular embodiments, the first polymerizing enzyme is E. faecium polymerase (SEQ ID Nos: 2-5). In particular embodiments, the first polymerizing enzyme is selected from any one of SEQ ID Nos. 23-33.

2. The recombinant polymerizing enzyme of paragraph 1, wherein the first polymerizing enzyme is Φ29 polymerase (SEQ ID NO: 1) and the second polymerizing enzyme is selected from any one of SEQ ID NOs: 2-33. In particular embodiments, the second polymerizing enzyme is selected from SEQ ID Nos: 2-5. In particular embodiments, the second polymerizing enzyme is selected from SEQ ID Nos: 23-33.

3. The recombinant polymerizing enzyme of any prior paragraph, wherein at least one to three additional amino acid segments of the first polymerizing enzyme have been replaced with corresponding amino acid segments from one or more polymerizing enzymes of Table 1, wherein the one or more polymerizing enzymes of Table 1 are different from the first polymerizing enzyme, and optionally wherein one or more of the corresponding amino acid segments comprises one or more amino acid insertions, deletions, or substitutions relative to their sequence in Table 1.

4. The recombinant polymerizing enzyme of any prior paragraph, wherein one or more of the segments comprises a domain of a polymerizing enzyme of Table 1.

5. The recombinant polymerizing enzyme of any prior paragraph, wherein one or more of the amino acid segments comprises a portion of a domain of a polymerizing enzyme of Table 1.

6. The recombinant polymerizing enzyme of paragraph 4 or 5, wherein one or more of the amino acid segments comprise one or more amino acids flanking the domain or portion thereof in a polymerizing enzyme of Table 1.

7. The recombinant polymerizing enzyme of any prior paragraph, wherein at least one amino acid insertion, deletion, or substitution corresponds to an amino acid insertion, deletion, or substitution found in a different naturally-occurring polymerizing enzyme of Table 1.

8. The recombinant polymerizing enzyme of any prior paragraph, wherein at least one amino acid insertion, deletion, or substitution corresponds to an amino acid insertion, deletion, or substitution that is not found in a naturally-occurring polymerizing enzyme of Table 1.

9. The recombinant polymerizing enzyme of any prior paragraph, wherein the one or more corresponding amino acid segments are selected from the group consisting of: amino acids 1-51 from the M2Y polymerase, amino acids 271-375 from the E. faecium polymerase, amino acids 72-89 from the E. faecium polymerase, and/or amino acids 445-449 from the E. faecium polymerase.

10. The recombinant polymerizing enzyme of any prior paragraph, wherein at least one amino acid insertion, deletion, or substitution is at a position corresponding to a position selected from positions: M8, V51, N62, I71, L107, K131, K135, L142, G135, L142, Y148, G197, Y224, Y226, E239, V250, N251, L253, Y281, I288, T301, R306, R308, D325, D341, K354, T368, E375, K379, Q380, A437, A444, P447, E466, D476, K478, A484, E508, D510, K512, E515, K539, D570, and T571 in Φ29 polymerase.

11. The recombinant polymerizing enzyme of paragraph 10, comprising one or more amino acid substitutions selected from MBR, V51A, N62D, I71V, L107I, K131E, K135Q, L142K, Y148I, G197D, Y224K, Y226F, E239G, V250A, V250I, N251R, L253A, L253H, Y281H, I288L, T301C, R306Q, R308L, D325E, D341E, K354R, T368F, E375K, E375Y, K379R, Q380R, A437G, A444T, E466K, D476H, P477D, K478D, A484C, A484Q, A484N, A484E, A484D, A484K, A484R, A484H, A484Y, and A484X (where X represents an unnatural amino acid, as described herein), E508R, D510K, D510R, K512Y, E515Q, K539E, D570S, and T571V.

12. The recombinant polymerizing enzyme of any prior paragraph, comprising one or more amino acid substitutions at positions corresponding to I71, L107, K135, L142, G197, Y224, E239, V250, L253, E375, A437, A444, E466, D476, A484, E508, D510, K512, E515, K539, D570, and T571 in SEQ ID NO: 1.

13. The recombinant polymerizing enzyme of paragraph 12, wherein the one or more amino acid substitutions are selected from I71V, L107I, K135Q, L142K, G197V, Y224K, E239G, V250I, L253A, E375Y, A437G, A444V, E466K, D476H, A484E, E508R, D510R, K512Y, E515Q, K539E, D570S, and T571V in SEQ ID NO: 1.

14. The recombinant polymerizing enzyme of any prior paragraph, comprising one or more amino acid substitutions at positions corresponding to K131, K135, L142, Y148, Y224, E239, V250, L253, R306, R308, E375, A437, E466, D476, A484, E508, D510, K512, E515, K539, D570, and T571 in SEQ ID NO: 1.

15. The recombinant polymerizing enzyme of paragraph 14, wherein the one or more amino acid substitutions are selected from K131E, K135Q, L142K, Y148I, Y224K, E239G, V250A, V250I, L253A, L253H, R306Q, R308L, E375Y, A437G, E466K, D476H, A484E, E508R, D510K, D510R, K512Y, E515Q, K539E, D570E, D570S, and T571V in SEQ ID NO: 1.

16. The recombinant polymerizing enzyme of paragraph 14, wherein the one or more amino acid substitutions are selected from K131E, L142K, Y148I, Y224K, E239G, V250A, L253H, E375Y, A437G, A484E, E508R, D510K, K512Y, E515Q, and D570E in SEQ ID NO: 1.

17. The recombinant polymerizing enzyme of any prior paragraph, wherein at least one or more of the substituted segments comprises an exonuclease region, a palm region, a TPR1 region, a fingers region, a TPR2 region, a thumb region, or a portion of any one thereof, and optionally comprising one or more flanking amino acids.

18. A recombinant polymerizing enzyme having an amino acid sequence that is at least 60%, 60-70%, 70-80%, or at least 80% identical to an amino acid sequence of Table 1 and comprising one or more amino acid modifications of Tables 2-7. In particular embodiments, the amino acid sequence of Table 1 is selected from any one of SEQ ID Nos. 2-5. In particular embodiments, the amino acid sequence of Table 1 is selected from any one of SEQ ID Nos. 23-33.

19. The recombinant polymerizing enzyme of paragraph 18, wherein the one or more amino acid modifications include at least one amino acid mutation.

20. The recombinant polymerizing enzyme of paragraph 18, wherein the one or more amino acid modifications include at least one domain substitution.

21. The recombinant polymerizing enzyme of paragraph 18, wherein the one or more amino acid modifications include at least one domain substitution and at least one amino acid mutation.

22. The recombinant polymerizing enzyme of paragraph 18 having a sequence selected from Table 2 or the recombinant polymerizing enzyme of paragraph 18 having a combination of modifications listed in Table 7.

23. The recombinant polymerizing enzyme of paragraph 18 having a sequence selected from Table 3 or Table 4.

24. The recombinant polymerizing enzyme of any prior paragraph, further comprising a purification tag.

25. The recombinant polymerizing enzyme of paragraph 24, wherein the purification tag is a C-terminal tag.

26. The recombinant polymerizing enzyme of paragraph 24, wherein the purification tag is an N-terminal tag.

27. The recombinant polymerizing enzyme of paragraph 24, 25, or 26, wherein the purification tag is a His tag.

28. The recombinant polymerizing enzyme of any prior paragraph, further comprising a coupling group.

29. The recombinant polymerizing enzyme of paragraph 28, wherein the coupling group is attached at a C-terminal end of the recombinant polymerizing enzyme.

30. The recombinant polymerizing enzyme of paragraph 28, wherein the coupling group is attached at an N-terminal end of the recombinant polymerizing enzyme.

31. The recombinant polymerizing enzyme of paragraph 28, 29, or 30, wherein the coupling group is a biotinylation sequence or a bis-biotinylation sequence.

32. The recombinant polymerizing enzyme of any prior paragraph comprising a His tag and a biotinylation sequence or a bis-biotinylation sequence.

33. The recombinant polymerizing enzyme of paragraph 18 immobilized on a surface.

34. The recombinant polymerizing enzyme of paragraph 33, wherein the surface comprises a nanoaperture.

35. An isolated nucleic acid molecule that encodes the recombinant polymerizing enzyme of paragraph 18.

36. A composition comprising the recombinant polymerizing enzyme of paragraph 18.

37. A method of sequencing a nucleic acid, the method comprising contacting the recombinant polymerizing enzyme of paragraph 18 with a sequencing reaction mixture.

38. A recombinant polymerizing enzyme having an amino acid sequence that is at least 60%, 60-70%, 70-80%, or at least 80% identical to an amino acid sequence of Table 1 and comprising an exonuclease region that is at least 60%, 60-70%, 70-80%, or at least 80% identical to an exonuclease region from a different polymerizing enzyme of Table 1, Table 2, Table 3, or Table 4. In particular embodiments, the amino acid sequence of Table 1 is selected from any one of SEQ ID Nos. 2-5. In particular embodiments, the amino acid sequence of Table 1 is selected from any one of SEQ ID Nos. 23-33.

39. A recombinant polymerizing enzyme having an amino acid sequence that is at least 60%, 60-70%, 70-80%, or at least 80% identical to an amino acid sequence of Table 1 and comprising a palm region that is at least 60%, 60-70%, 70-80%, or at least 80% identical to a palm region from a different polymerizing enzyme of Table 1, Table 2, or Table 3. In particular embodiments, the amino acid sequence of Table 1 is selected from any one of SEQ ID Nos. 2-5. In particular embodiments, the amino acid sequence of Table 1 is selected from any one of SEQ ID Nos. 23-33.

40. A recombinant polymerizing enzyme having an amino acid sequence that is at least 60%, 60-70%, 70-80%, or at least 80% identical to an amino acid sequence of Table 1 and comprising a TPR1 region that is at least 60%, 60-70%, 70-80%, or at least 80% identical to a TPR1 region from a different polymerizing enzyme of Table 1, Table 2, or Table 3. In particular embodiments, the amino acid sequence of Table 1 is selected from any one of SEQ ID Nos. 2-5. In particular embodiments, the amino acid sequence of Table 1 is selected from any one of SEQ ID Nos. 23-33.

41. A recombinant polymerizing enzyme having an amino acid sequence that is at least 60%, 60-70%, 70-80%, or at least 80% identical to an amino acid sequence of Table 1 and comprising a fingers region that is at least 60%, 60-70%, 70-80%, or at least 80% identical to a fingers region from a different polymerizing enzyme of Table 1, Table 2, or Table 3. In particular embodiments, the amino acid sequence of Table 1 is selected from any one of SEQ ID Nos. 2-5. In particular embodiments, the amino acid sequence of Table 1 is selected from any one of SEQ ID Nos. 23-33.

42. A recombinant polymerizing enzyme having an amino acid sequence that is at least 80% identical to an amino acid sequence of Table 1 and comprising a TPR2 region that is at least 80% identical to a TPR2 region from a different polymerizing enzyme of Table 1, Table 2, or Table 3. In particular embodiments, the amino acid sequence of Table 1 is selected from any one of SEQ ID Nos. 2-5. In particular embodiments, the amino acid sequence of Table 1 is selected from any one of SEQ ID Nos. 23-33.

43. A recombinant polymerizing enzyme having an amino acid sequence that is at least 60%, 60-70%, 70-80%, or at least 80% identical to an amino acid sequence of Table 1 and comprising a thumb region that is at least 60%, 60-70%, 70-80%, or at least 80% identical to a thumb region from a different polymerizing enzyme of Table 1, Table 2, or Table 3. In particular embodiments, the amino acid sequence of Table 1 is selected from any one of SEQ ID Nos. 2-5. In particular embodiments, the amino acid sequence of Table 1 is selected from any one of SEQ ID Nos. 23-33.

44. A recombinant polymerizing enzyme having an amino acid sequence that is at least 60%, 60-70%, 70-80%, or at least 80% identical to an amino acid sequence of Table 1 and comprising two or more regions of any of the prior paragraphs. In particular embodiments, the amino acid sequence of Table 1 is selected from any one of SEQ ID Nos. 2-5. In particular embodiments, the amino acid sequence of Table 1 is selected from any one of SEQ ID Nos. 23-33.

45. A sequencing method comprising performing a sequencing reaction using one or more polymerases of any prior paragraph.

46. A modified recombinant enzyme comprising a first segment and a second segment, wherein:
the first segment comprises an amino acid sequence corresponding to a first reference segment, said first reference segment containing amino acids 197-271 of SEQ ID NO: 2, wherein the amino acid sequence of the first segment is at least 80%, 80-90%, 90-95%, or at least 95% identical to the amino acid sequence of the first reference segment, and wherein the first segment has a higher isoelectric point than the first reference segment; and
the second segment comprises an amino acid sequence corresponding to a second reference segment, said second reference segment containing amino acids 443-528 of SEQ ID NO: 2, wherein the amino acid sequence of the second segment is at least 80%, 80-90%, 90-95%, or at least 95% identical to the amino acid sequence of the second reference segment, and wherein the second segment has a higher isoelectric point than the second reference segment. In particular embodiments, the first segment comprises an amino acid sequence that is at least 80%, 80-90%, 90-95%, or at least 95% identical to 197-271 of SEQ ID NO: 2 and the second segment comprises an amino acid sequence that is at least 80%, 80-90%, 90-95%, or at least 95% identical to amino acids 443-528 of SEQ ID NO: 2.

47. A modified recombinant enzyme comprising a first segment comprising an amino acid sequence corresponding to a reference segment, said reference segment containing amino acids 1-196 of SEQ ID NO: 2, wherein the amino acid sequence of the first segment is at least 80%, 80-90%, 90-95%, or at least 95% identical to the amino acid sequence of the reference segment; and wherein the first segment has a higher isoelectric point than the reference segment. In particular embodiments, the first segment comprises an amino acid sequence that is at least 80%, 80-90%, 90-95%, or at least 95% identical to 1-196 of SEQ ID NO: 2.

48. A modified recombinant enzyme comprising a first segment and a second segment, wherein:
the first segment comprises an amino acid sequence corresponding to a first reference segment, said first reference segment containing amino acids 1-271 of SEQ ID NO: 2, wherein the amino acid sequence of the first segment is at least 80%, 80-90%, 90-95%, or at least 95% identical to the amino acid sequence of the first reference segment, and wherein the first segment has a higher isoelectric point than the first reference segment; and
the second segment comprises an amino acid sequence corresponding to a second reference segment, said second reference segment containing amino acids 443-528 of SEQ ID NO: 2, wherein the amino acid sequence of the second segment is at least 80%, 80-90%, 90-95%, or at least 95% identical to the amino acid sequence of the second reference segment, and wherein the second segment has a higher isoelectric point than the second reference segment. In particular embodiments, the first segment comprises an amino acid sequence that is at least 80%, 80-90%, 90-95%, or at least 95% identical to 1-271 of SEQ ID NO: 2 and the second segment comprises an amino acid sequence that is at least 80%, 80-90%, 90-95%, or at least 95% identical to amino acids 443-528 of SEQ ID NO: 2.

49. The modified recombinant enzyme of any one of paragraphs 46-48, wherein the amino acid sequence of the modified recombinant enzyme comprises a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, V443, L445, A446, S447, V449, T450, W452, G453, Y455, F465, N467, T479, E482, A484, E485, A486, L490, D492, S493, K495, K500, S503, Q506, Q513, E519, D521, E523, and V526 of SEQ ID NO: 2.

50. The modified recombinant enzyme of paragraph 49, wherein a modification is an amino acid substitution selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, P147Q, P147T, I148K, I148H, I148R, E152D, I153V, P160A, D167P, D167K, D171K, D171H, D171R, N175T, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S503A, S503T, Q506K, Q513D, D521K, D521R, D521H, E523R, E523V, E523Y, E523F, E523H, E523W, and V526L.

51. The modified recombinant enzyme of paragraph 49 or paragraph 50, wherein the amino acid sequence of the modified recombinant enzyme comprises a modification at one or more positions corresponding to E139, E142, N145, I148, D167, D171, D189, N467, E482, D492, K495, D521, and E523.

52. The modified recombinant enzyme of paragraph 51, wherein a modification is an amino acid substitution selected from the group consisting of E139K, E139Q, E139R, E139H, E142K, E142H, E142R, E142Q, N145K, I148K, I148H, I148R, D167P, D167K, D171K, D171H, D171R, D189H, D189K, D189R, N467R, N467K, N467H, N467S, N467T, E482K, E482H, E482R, D492H, D492K, D492R, K495R, D521K, D521H, D521R, E523K, E523Y, E523H, E523R, E523F, and E523W.

53. The modified recombinant enzyme of any one of paragraphs 46-52, wherein the amino acid sequence of the modified recombinant enzyme comprises a modification at one or more positions corresponding to P273, P275, R308, V315, Q317, S319, L320, I322, Q323, D337, E338, D341, T345, F352, F353, T364, D374, I384, E385, N388, E391, A396, N397, G400, D414, D425, R429, E436, L437, D533, R534, E537, G547, E545, L555, P556, R558, T559, V564, T568, M569, and T571 of SEQ ID NO: 2.

54. The modified recombinant enzyme of paragraph 53, wherein a modification is an amino acid substitution selected from the group consisting of P273S, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, I384T, I384F, I384S, E385Y, E385Y, N388T, E391Y, E391W, E391F, E391H, E391M, E391K, E391R, A396Q, N397L, G400L, D414V, D425N, R429G, E436R, E436G, L437Y, L437E, D533A, R534K, E537K, E537H, E537R, E545K, G547S, L555K, L555R, P556A, R558H, T559V, V564L, T568D, T568S, M569K, M569T, M569V, and T571S.

55. The modified recombinant enzyme of paragraph 53, wherein a modification is an amino acid substitution selected from the group consisting of D374G, E385Y, E391Y, E391W, E391K, E391F, D533A, E537K, E537H, E537R, and E545K.

56. The modified recombinant enzyme of any one of paragraphs 53-55, wherein the modified recombinant enzyme comprises a combination of modifications listed in Table 7.

57. The modified recombinant enzyme of any one of paragraphs 53-55, wherein the amino acid sequence of the modified recombinant enzyme comprises a modification at positions corresponding to E142, I148, D189, V261, L264, R308, E391, E482, D492, K500, D521, E523, and E537.

58. The modified recombinant enzyme of paragraph 57, wherein:
the modification at position E142 is E142K;
the modification at position I148 is I148K;
the modification at position D189 is D189K;
the modification at position V261 is V261A;
the modification at position L264 is L264H;
the modification at position R308 is R308G;
the modification at position E391 is E391Y;
the modification at position E482 is E482K;
the modification at position D492 is D492H;
the modification at position K500 is K500E;
the modification at position D521 is D521K;
the modification at position E523 is E523K; and
the modification at position E537 is E537K.

59. The modified recombinant enzyme of paragraph 58, wherein the modified recombinant enzyme comprises the amino acid sequence of SEQ ID NO: 88.

60. The modified recombinant enzyme of paragraph 58, wherein the amino acid sequence of the modified recombinant enzyme comprises a modification at position E60.

61. The modified recombinant enzyme of paragraph 60, wherein the modification at E60 is E60L.

62. The modified recombinant enzyme of paragraph 61, wherein the modified recombinant enzyme comprises the amino acid sequence of SEQ ID NO: 157.

63. The modified recombinant enzyme of paragraph 61, wherein the modified recombinant enzyme further comprises a bis-biotin tag.

64. The modified recombinant enzyme of paragraph 63, wherein the modified recombinant enzyme comprises the amino acid sequence of SEQ ID NO: 180.

65. A modified recombinant enzyme comprising one or more segments selected from:
a first segment having an amino acid sequence that is at least 80%, 80-90%, 90-95%, or at least 95% identical to amino acids 1-196 of SEQ ID NO: 2, wherein the amino acid sequence of the first segment comprises a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, and D189 of SEQ ID NO: 2;
a second segment having an amino acid sequence that is at least 80%, 80-90%, 90-95%, or at least 95% identical to amino acids 197-271 of SEQ ID NO: 2, wherein the amino acid sequence of the second segment comprises a modification at one or more positions corresponding to Q206, T211, S216, R217, D232, A236, V247, I253, V261, L264, and 5267 of SEQ ID NO: 2; and/or
a third segment having an amino acid sequence that is at least 80%, 80-90%, 90-95%, or at least 95% identical to amino acids 443-528 of SEQ ID NO: 2, wherein the amino acid sequence of the third segment comprises a modification at one or more positions corresponding to V443, L445, A446, S447, V449, T450, W452, G453, Y455, F465, N467, T479, E482, A484, E485, A486, L490, D492, S493, K495, K500, S503, Q506, Q513, E519, D521, E523, and V526 of SEQ ID NO: 2.

66. The modified recombinant enzyme of paragraph 65, wherein the modified recombinant enzyme comprises the first segment and the second segment.

67. The modified recombinant enzyme of paragraph 65, wherein the modified recombinant enzyme comprises the second segment and the third segment.

68. The modified recombinant enzyme of paragraph 65, wherein the modified recombinant enzyme comprises the first segment and the third segment.

69. The modified recombinant enzyme of paragraph 65, wherein the modified recombinant enzyme comprises the first segment, the second segment and the third segment.

70. The modified recombinant enzyme of any one of paragraphs 65-69, wherein a modification is an amino acid substitution selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, P147Q, P147T, I148K, I148H, I148R, E152D, I153V, P160A, D167P, D167K, D171K, D171H, D171R, N175T, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S502A, S503T, Q506K, Q513D, D521K, D521R, D521H, E523R, E523V, E523Y, E523F, E523H, E523W, and V526L.

71. The modified recombinant enzyme of any one of paragraphs 65-70, wherein the amino acid sequence of the modified recombinant enzyme comprises a modification at one or more positions corresponding to E139, E142, N145, I148, D167, D171, D189, N467, E482, D492, K495, D521, and E523.

72. The modified recombinant enzyme of paragraph 71, wherein a modification is an amino acid substitution selected from the group consisting of E139K, E139Q, E139R, E139H, E142K, E142H, E142R, E142Q, N145K, I148K, I148H, I148R, D167P, D167K, D171K, D171H, D171R, D189K, D189H, D189R, N467R, N467K, N467H, N467S, N467T, E482K, E482H, E482R, D492H, D492K, D492R, K495R, D521K, D521H, D521R, E523K, E523Y, E523H, E523R, E523F, and E523W.

73. The modified recombinant enzyme of any one of paragraphs 65-72, wherein the amino acid sequence of the modified recombinant enzyme comprises a modification at one or more positions corresponding to P273, P275, R308, V315, Q317, S319, L320, I322, Q323, D337, E338, D341, T345, F352, F353, T364, D374, I384, E385, N388, E391, A396, N397, G400, D414, D425, R429, E436, L437, D533, R534, E537, G547, E545, L555, P556, R558, T559, V564, T568, M569, and T571 of SEQ ID NO: 2.

74. The method of paragraph 73, wherein a modification is an amino acid substitution selected from the group consisting of P273S, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, I384T, I384F, I384S, E385Y, N388T, E391Y, E391W, E391F, E391H, E391M, E391K, E391R, A396Q, N397L, G400L, D414V, D425N, R429G, E436R, E436G, L437Y, L437E, D533A, R534K, E537K, E537H, E537R, E545K, G547S, L555K, L555R, P556A, R558H, T559V, V564L, T568D, T568S, M569K, M569T, M569V, and T571S.

75. The method of paragraph 73, wherein a modification is an amino acid substitution selected from the group consisting of D374G, E385Y, E391Y, E391W, E391K, E391F, D533A, E537K, E537H, E537R, and E545K.

76. The modified recombinant enzyme of any one of paragraphs 73-75, wherein the modified recombinant enzyme comprises a combination of modifications listed in Table 7.

77. The modified recombinant enzyme of any one of paragraphs 73-76, wherein the amino acid sequence of the modified recombinant enzyme comprises a modification at positions corresponding to E142, I148, D189, V261, L264, R308, E391, E482, D492, K500, D521, E523, and E537.

78. The modified recombinant enzyme of paragraph 77, wherein:
the modification at position E142 is E142K;
the modification at position I148 is I148K;
the modification at position D189 is D189K;
the modification at position V261 is V261A;
the modification at position L264 is L264H;
the modification at position R308 is R308G;
the modification at position E391 is E391Y;
the modification at position E482 is E482K;
the modification at position D492 is D492H;
the modification at position K500 is K500E;
the modification at position D521 is D521K;
the modification at position E523 is E523K; and
the modification at position E537 is E537K.

79. The modified recombinant enzyme of paragraph 78, wherein the modified recombinant enzyme comprises the amino acid sequence of SEQ ID NO: 88.

80. The modified recombinant enzyme of paragraph 78, wherein the amino acid sequence of the modified recombinant enzyme comprises a modification at position E60.

81. The modified recombinant enzyme of paragraph 80, wherein the modification at E60 is E60L.

82. The modified recombinant enzyme of paragraph 81, wherein the modified recombinant enzyme comprises the amino acid sequence of SEQ ID NO: 157.

83. The modified recombinant enzyme of paragraph 81, wherein the modified recombinant enzyme further comprises a bis-biotin tag.

84. The modified recombinant enzyme of paragraph 83, wherein the modified recombinant enzyme comprises the amino acid sequence of SEQ ID NO: 180.

85. A modified recombinant enzyme comprising an amino acid sequence comprising: (i) a first segment, a second segment, a third segment, a fourth segment, a fifth segment, a sixth segment, and a seventh segment; and (ii) a modification at one or more positions corresponding to E139, E142, N145, I148, D167, D171, D189, D374, E385, E391, N467, E482, D492, K495, D521, E523, D533, E537, and E545 of SEQ ID NO: 2; wherein
the first segment comprises an amino acid sequence that is at least 80%, 80-90%, 90-95%, or at least 95% identical to a exonuclease region of a polymerizing enzyme of Table 1, Table 2, or Table 3;
the second segment and the sixth segment collectively comprise an amino acid sequence that is at least 80%, 80-90%, 90-95%, or at least 95% identical to a palm region of a polymerizing enzyme of Table 1, Table 2, or Table 3;
the third segment comprises an amino acid sequence that is at least 80%, 80-90%, 90-95%, or at least 95% identical to a TPR1 region of a polymerizing enzyme of Table 1, Table 2, or Table 3;
the fourth segment comprises an amino acid sequence that is at least 80%, 80-90%, 90-95%, or at least 95% identical to a finger region of a polymerizing enzyme of Table 1, Table 2, or Table 3;
the fifth segment comprises an amino acid sequence that is at least 80%, 80-90%, 90-95%, or at least 95% identical to a TPR2 region of a polymerizing enzyme of Table 1, Table 2, or Table 3; and
the seventh segment comprises an amino acid sequence that is at least 80%, 80-90%, 90-95%, or at least 95% identical to a thumb region of a polymerizing enzyme of Table 1, Table 2, or Table 3. In particular embodiments, a polymerizing enzyme from Table 1 is selected from any one of SEQ ID Nos.: 2-5. In some embodiments, a polymerizing enzyme from Table 1 is selected from any one of SEQ ID Nos: 23-33.

86. The modified recombinant enzyme of paragraph 85, wherein a modification is an amino acid substitution selected from the group consisting of E139K, E139Q, E139R, E139H, E142K, E142H, E142R, E142Q, N145K, I148K, I148H, I148R, D167P, D167K, D171K, D171H, D171R, D189K, D189H, D189R, D374G, E385Y, E391Y, E391W, E391K, E391F, N467R, N467K, N467H, N467S, N467T, E482K, E482H, E482R, D492H, D492K, D492R, K495R, D521K, D521H, D521R, E523K, E523Y, E523H, E523R, E523F, E523W, D533A, E537K, E537H, E537R, and E545K.

87. The modified recombinant enzyme of paragraph 85 or 86, further comprising a modification at one or more positions corresponding to K4, T13, S22, V25, C26, D27, N33, I34, F36, S42, D54, N59, E60, E65, E85, M95, N106, T110, T114, K119, Q122, Y133, P136, P147, E152, I153, P160, N175, F188, Q206, T211, S216, R217, D232, A236, V247, I253, V261, L264, S267, P273, P275, R308, V315, Q317, S319, L320, I322, Q323, D337, E338, D341, T345, F352, F353, T364, I384, N388, A396, N397, G400, D414, D425, R429, E436, L437, V443, L445, A446, S447, V449, T450, W452, G453, Y455, F465, T479, A484, E485, A486, L490, 5493, K500, S503, Q506, Q513, E519, V526, R534, G547, L555, P556, R558, T559, V564, T568, M569, and T571 of SEQ ID NO: 2.

88. The modified recombinant enzyme of paragraph 87, wherein a modification is an amino acid substitution selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, P147Q, P147T, E152D, I153V, P160A, N175T, F188C, Q206R, Q206K, Q206H, T211A, S216G, S216R, R217G, D232K, A236G, V247D, I253H, I253A, V261A, V261I, V261L, L264H, L264A, L264M, S267A, P273S, P275S, E283K, V315L, S319R, R308G, G308R, Q317R, S319R, L320M, L320T, I322K, Q323G, Q323V, Q323R, D337G, E338K, D341T, T345I, F352I, F353C, T364I, I384T, I384F, I384S, N388T, A396Q, N397L, G400L, D414V, D425N, R429G, E436R, E436G, L437Y, L437E, V443T, L445M, A446G, S447V, V449I, T450A, W452Y, G453A, Y455W, F465Y, T479V, A484E, E485D, A486E, L490M, S493P, K500E, S503A, S503T, Q506K, Q513D, V526L, R534K, G547S, L555K, L555R, P556A, R558H, T559V, V564L, T568D, T568S, M569K, M569T, M569V, and T571S.

89. The modified recombinant enzyme of paragraph 87 or 88, wherein the modified recombinant enzyme comprises a combination of modifications listed in Table 7.

90. A modified recombinant enzyme comprising:
an amino acid sequence this is at least 60%, 60-70%, 70-80%, or at least 80% identical to SEQ ID NO: 2; and
an extended palm domain, wherein the extended palm domain comprises an addition of an amino acid sequence that is at least 80%, 80-90%, 90-95%, or at least 95% identical to amino acids 505-524 of SEQ ID NO: 1.

91. The modified recombinant enzyme of paragraph 90 further comprising a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, V443, L445, A446, S447, V449, T450, W452, G453, Y455, F465, N467, T479, E482, A484, E485, A486, L490, D492, S493, K495, K500, S503, Q506, Q513, E519, D521, E523, and V526 of SEQ ID NO: 2.

92. The modified recombinant enzyme of paragraph 91, wherein a modification is an amino acid substitution selected from the group consisting of K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, P147Q, P147T, I148K, I148H, I148R, E152D, I153V, P160A, D167P, D167K, D171K, D171H, D171R, N175T, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S503A, S503T, Q506K, Q513D, D521K, D521R, D521H, E523R, E523V, E523Y, E523F, E523H, E523W, and V526L.

93. The modified recombinant enzyme of paragraph 91 or 92, wherein the amino acid sequence of the modified recombinant enzyme further comprises a modification at one or more positions corresponding to E139, E142, N145, I148, D167, D171, D189, N467, E482, D492, K495, D521, and E523.

94. The modified recombinant enzyme of paragraph 93, wherein a modification is an amino acid substitution selected from the group consisting of E139K, E139Q, E139R, E139H, E142K, E142H, E142R, E142Q, N145K, I148K, I148H, I148R, D167P, D167K, D171K, D171H, D171R, D189K, D189H, D189R, N467R, N467K, N467H, N467S, N467T, E482K, E482H, E482R, D492H, D492K, D492R, K495R, D521K, D521H, D521R, E523K, E523Y, E523H, E523R, E523F, and E523W.

95. The modified recombinant enzyme of any one of paragraphs 91-94, wherein the amino acid sequence of the modified recombinant enzyme comprises a modification at one or more positions corresponding to P273, P275, R308, V315, Q317, S319, L320, I322, Q323, D337, E338, D341, T345, F352, F353, T364, D374, I384, E385, N388, E391, A396, N397, G400, D414, D425, R429, E436, L437, D533, R534, E537, G547, E545, L555, P556, R558, T559, V564, T568, M569, and T571 of SEQ ID NO: 2.

96. The method of paragraph 95, wherein a modification is an amino acid substitution selected from the group consisting of P273S, P275S, E283K, V315L, S319R, R308G, G308R, Q317R, S319R, L320M, L320T, I322K, Q323G, Q323V, Q323R, D337G, E338K, D341T, T345I, F352I, F353C, T364I, D374G, I384T, I384F, I384S, E385Y, N388T, E391Y, E391W, E391F, E391H, E391M, E391K, E391R, A396Q, N397L, G400L, D414V, D425N, R429G, E436R, E436G, L437Y, L437E, D533A, R534K, E537K, E537H, E537R, E545K, G547S, L555K, L555R, P556A, R558H, T559V, V564L, T568D, T568S, M569K, M569T, M569V, and T571S.

97. The method of paragraph 95, wherein a modification is an amino acid substitution selected from the group consisting of D374G, E385Y, E391Y, E391W, E391K, E391F, D533A, E537K, E537H, E537R, and E545K.

98. The modified recombinant enzyme of any one of paragraphs 95-97, wherein the modified recombinant enzyme comprises a combination of modifications listed in Table 7.

99. A modified recombinant enzyme having an amino acid sequence that is at least 60%, 60-70%, 70-80%, or at least 80% identical to any one of SEQ ID NOs: 1-33, wherein the amino acid sequence comprises a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, P273, P275, R308, V315, Q317, S319, L320, I322, Q323, D337, E338, D341, T345, F352, F353, T364, D374, I384, E385, N388, E391, A396, N397, G400, D414, D425, R429, E436, L437, V443, L445, A446, S447, V449, T450, W452, G453, Y455, F465, N467, T479, E482, A484, E485, A486, L490, D492, S493, K495, K500, S503, Q506, Q513, E519, D521, E523, V526, D533, R534, E537, G547, E545, L555, P556, R558, T559, V564, T568, M569, and T571 of E. faecium polymerase (SEQ ID NO: 2). In particular embodiments, a modified recombinant enzyme has an amino acid sequence that is at least 60%, 60-70%, 70-80%, or at least 80% identical to any one of SEQ ID NOs: 2-5 and comprises a modification at one or more of the positions. In a particular embodiment, a modified recombinant enzyme is a modified E. faecium polymerase that has an amino acid sequence that is at least 60%, 60-70%, 70-80%, or at least 80% identical to any one of SEQ ID NO: 2 and comprises a modification at one or more of the positions. In a particular embodiments, a modified recombinant enzyme is a modified E. faecium polymerase that comprises the amino acid sequence of SEQ ID NO: 2 and comprises a modification at one or more of the positions. In some embodiments, a modified recombinant enzyme has an amino acid sequence that is 60%, 60-70%, 70-80%, or at least 80% identical to any one of SEQ ID NOs: 23-33, and comprises a modification at one or more of the positions.

100. The modified recombinant enzyme of paragraph 99, comprising a modification at one or both positions corresponding to T568 and M569 of SEQ ID NO: 2.

101. The modified recombinant enzyme of paragraph 100, wherein a modification is an amino acid substitution selected from the group consisting of T568D, T568S, M569T, and M569V.

102. The modified recombinant enzyme of paragraph 100 or paragraph 101, wherein the modified recombinant enzyme has improved processivity relative to E. faecium polymerase (SEQ ID NO: 2).

103. The modified recombinant enzyme of any one of paragraphs 99-102, comprising a modification at a position corresponding to N59 of SEQ ID NO: 2.

104. The modified recombinant enzyme of paragraph 103, wherein the modification is N59D.

105. The modified recombinant enzyme of paragraph 103 or paragraph 104, wherein the modified recombinant enzyme has altered exonuclease activity relative to *E. faecium* polymerase (SEQ ID NO: 2).

106. The modified recombinant enzyme of any one of paragraphs 99-105, comprising a modification at one or more positions corresponding to V261, L264, S267, I384, E391, W452, G453, Y455, D492, and K500 of SEQ ID NO: 2.

107. The modified recombinant enzyme of paragraph 106, wherein a modification is an amino acid substitution selected from the group consisting of V261A, V261I, L264A, L264H, L264M, S267A, I384F, I384S, E391Y, E391W, E391F, E391H, E391M, E391K, E391R, W452Y, G453A, Y455W, D492H, and K500E.

108. The modified recombinant enzyme of paragraph 106 or paragraph 107, wherein the modified recombinant enzyme has improved nucleotide substrate utilization relative to *E. faecium* polymerase (SEQ ID NO: 2).

109. The modified recombinant enzyme of any one of paragraphs 99-108, comprising a modification at one or more positions corresponding to E65, Y133, E391, G400, V443, L445, A446, S447, V449, T450, S503, E523, L555, and P556 of SEQ ID NO: 2.

110. The modified recombinant enzyme of paragraph 109, wherein a modification is an amino acid substitution selected from the group consisting of E65S, Y133L, E391Y, E391W, E391F, E391K, G400L, V443T, L445M, A446G, S447V, V449I, T450A, S502A, E523K, E523Y, E523F, E523H, E523W, L555K, and P556A.

111. The modified recombinant enzyme of paragraph 109 or paragraph 110, wherein the modified recombinant enzyme has improved accuracy relative to *E. faecium* polymerase (SEQ ID NO: 2).

112. The modified recombinant enzyme of any one of paragraphs 99-111, comprising a modification at one or more positions corresponding to Q317, 5319, 1322, Q323, R429, L555, and T559 of SEQ ID NO: 2.

113. The modified recombinant enzyme of paragraph 112, wherein a modification is an amino acid substitution selected from the group consisting of Q317R, S319R, I322K, Q323G, R429G, L555K, and T559V.

114. The modified recombinant enzyme of paragraph 112 or paragraph 113, wherein the modified recombinant enzyme has an increased DNA-binding affinity relative to *E. faecium* polymerase (SEQ ID NO: 2).

115. The modified recombinant enzyme of any one of paragraphs 99-114, comprising a modification at one or more positions corresponding to E391, S503 and E523 of SEQ ID NO: 2.

116. The modified recombinant enzyme of paragraph 115, wherein a modification is an amino acid substitution selected from the group consisting of E391Y, E391W, E391F, E391K, S503A, E523K, E523Y, E523F, E523H, and E523W.

117. The modified recombinant enzyme of paragraph 115 or paragraph 116, wherein the modified recombinant enzyme has an increased analog-binding affinity relative to *E. faecium* polymerase (SEQ ID NO: 2).

118. The modified recombinant enzyme of any one of paragraphs 99-117, comprising a modification at one or more positions corresponding to Q206, E436 and L437 of SEQ ID NO: 2.

119. The modified recombinant enzyme of paragraph 118, wherein a modification is an amino acid substitution selected from the group consisting of Q206R, Q206K, Q206H, E436R, L437Y, and L437E.

120. The modified recombinant enzyme of paragraph 118 or paragraph 119, wherein the modified recombinant enzyme has improved strand displacement relative to *E. faecium* polymerase (SEQ ID NO: 2).

121. The modified recombinant enzyme of any one of paragraphs 99-120, comprising a modification at one or more positions corresponding to E436, L437, R534, T568, and M569 of SEQ ID NO: 2.

122. The modified recombinant enzyme of paragraph 121, wherein a modification is an amino acid substitution selected from the group consisting of E436R, L437Y, L437E, R534K, T568D, T568S, M569T, and M569V.

123. The modified recombinant enzyme of paragraph 121 or paragraph 122, wherein the modified recombinant enzyme has an enhanced average read length relative to *E. faecium* polymerase (SEQ ID NO: 2).

124. The modified recombinant enzyme of any one of paragraphs 99-123, comprising a modification at one or more positions corresponding to T13, V25, C26, D27, N33, I34, F36, S42, D54, M95, T110, T114, K119, P136, P147, E152, I153, P160, N175, F188, 5216, R217, D232, A236, V247, P273, E283, V315, S319, L320, Q323, E338, T345, F352, F353, T364, D414, D425, E436, F465, E485, A486, L490, S503, E523, V526, G547, L555, R558, V564, M569, and T571 of SEQ ID NO: 2.

125. The modified recombinant enzyme of paragraph 124, wherein a modification is an amino acid substitution selected from the group consisting of T13N, V25L, C26W, D27E, N33T, I34V, F36V, S42T, D54Y, M95T, M95K, T110I, T114S, K119Q, P136T, P147Q, P147T, E152D, I153V, P160A, N175T, F188C, S216G, S216R, R217G, D232H, A236G, V247D, P273S, E283K, V315L, S319R, L320M, L320T, Q323R, E338K, T345I, F352I, F353C, T364I, D414V, D425N, E436G, F465Y, E485D, A486E, L490M, S503T, E523V, V526L, G547S, L555R, R558H, V564L, M569K, and T571S.

126. The modified recombinant enzyme of paragraph 124 or paragraph 125, wherein the modified recombinant enzyme has an increased replication capacity relative to *E. faecium* polymerase (SEQ ID NO: 2).

127. The modified recombinant enzyme of any one of paragraphs 99-126, comprising a modification at one or more positions corresponding to E139, E142, N145, I148, D167, D171, D189, D374, E385, E391, N467, E482, D492, K495, D521, E523, D533, E537, and E545 of SEQ ID NO: 2.

128. The modified recombinant enzyme of paragraph 127, wherein a modification is an amino acid substitution selected from the group consisting of E139K, E139Q, E139R, E139H, E142K, E142H, E142R, E142Q, N145K, I148K, I148H, I148R, D167P, D167K, D171K, D171H, D171R, D189K, D189H, D189R, D374G, E385Y, E391Y, E391W, E391K, E391F, N467R, N467K, N467H, N467S, N467T, E482K, E482H, E482R, D492H, D492K, D492R, K495R, D521K, D521H, D521R, E523K, E523Y, E523H, E523R, E523F, E523W, D533A, E537K, E537H, E537R, and E545K.

129. The modified recombinant enzyme of paragraph 127 or paragraph 128, wherein the modified recombinant enzyme has an increased electropositive surface charge relative to *E. faecium* polymerase (SEQ ID NO: 2).

130. The modified recombinant enzyme of any one of paragraphs 99-129, comprising a modification at one or more positions corresponding to K4, S22, D27, I34, D54, E60, E85, M95, N106, T110, Q122, Y133, P136, P147, D167, T211, D232, P275, R308, S319, L320, E323, D337, E338, D341, T345, F352, T364, D414, F465, T479, E485, L490, S493, Q513, and R558 of SEQ ID NO: 2.

131. The modified recombinant enzyme of paragraph 130, wherein a modification is an amino acid substitution selected from the group consisting of K4R, S22A, D27E, I34V, D54Y, E60V, E60L, E85P, M95K, T110I, N106G, Q122V, Y133L, P136T, P147Q, P147T, D167P, T211A, D232K, P275S, R308G, S319R, L320M, Q323V, D337G, E338K, D341T, T345I, F352I, T364I, D414V, F465Y, T479V, E485D, L490M, S493P, Q513D, and R558H.

132. The modified recombinant enzyme of paragraph 130 or paragraph 131, wherein the modified recombinant enzyme has an increased stability relative to *E. faecium* polymerase (SEQ ID NO: 2).

133. The modified recombinant enzyme of any one of paragraphs 99-132, wherein the modified recombinant enzyme comprises a combination of modifications listed in Table 7.

134. A composition comprising the modified recombinant enzyme of any one of paragraphs 46-133.

135. A method of sequencing a nucleic acid, the method comprising contacting the modified recombinant enzyme of any one of paragraphs 46-133 with a sequencing reaction mixture.

All of the features disclosed in this specification may be combined in any combination. Each feature disclosed in this specification may be replaced by an alternative feature serving the same, equivalent, or similar purpose. Thus, unless expressly stated otherwise, each feature disclosed is only an example of a generic series of equivalent or similar features.

From the above description, one skilled in the art can easily ascertain the essential characteristics of the present invention, and without departing from the spirit and scope thereof, can make various changes and modifications of the invention to adapt it to various usages and conditions. Thus, other embodiments are also within the claims.

EQUIVALENTS AND SCOPE

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents, and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03. It should be appreciated that embodiments described in this document using an open-ended transitional phrase (e.g., "comprising") are also contemplated, in alternative embodiments, as "consisting of" and "consisting essentially of" the feature described by the open-ended transitional phrase. For example, if the disclosure describes "a composition comprising A and B," the disclosure also contemplates the alternative embodiments "a composition consisting of A and B" and "a composition consisting essentially of A and B."

nant DNA polymerase comprises a modification at one or more positions corresponding to K4, T13, S22, V25, C26, D27, N33, I34, F36, S42, D54, N59, E60, E65, E85, M95, N106, T110, T114, K119, Q122, Y133, P136, E139, E142, N145, P147, I148, E152, I153, P160, D167, D171, N175, F188, D189, Q206, T211, S216, R217, D232, A236, V247, I253, V261, L264, S267, V443, L445, A446, S447, V449, T450, W452, G453, Y455, F465, N467, T479, E482, A484, E485, A486, L490, D492, S493, K495, K500, S503, Q506, Q513, E519, D521, E523, and V526 of SEQ ID NO: 2, wherein optionally, the modification is an amino acid substitution selected from the group consisting of: K4R, T13N, S22A, V25L, C26W, D27E, N33T, I34V, F36V, S42T, D54Y, N59D, E60L, E60V, E65S, E85P, M95T, M95K, N106G, T110I, T114S, K119Q, Q122V, Y133L, P136T, E139K, E139Q, E139R, E139H, E142K, E142Q, E142R, E142H, N145K, N145H, N145R, P147Q, P147T, I148K, I148H, I148R, E152D, I153V, P160A, D167P, D167K, D167H, D167R, D171K, D171H, D171R, N175T, N175Y, F188C, D189K, D189H, D189R, Q206R, Q206K, Q206H, T211A, S216G, S216R, R217G, D232K, A236G, V247D, I253H, I253A, V261A, V261I, V261L, L264H, L264A, L264M, S267A, V443T, L445M, A446G, S447V, V449I, T450A, W452Y, G453A, Y455W, F465Y, N467R, N467K, N467H, N467S, N467T, T479V, E482K, E482H, E482R, A484E, E485D, A486E, L490M, D492H, D492K, D492R, D492A, H492S, S493P, K495R, K500E, S503A, S503T, Q506K, Q513D, D521K, D521R, D521H, E523R, E523V, E523Y, E523F, E523H, E523W, and V526L.

SEQUENCE LISTING (845 sequences)

SEQ ID NO: 1 - protein, 575 aa, Bacillus phage phi29 [sequence omitted]

SEQ ID NO: 2 - protein, 573 aa, Enterococcus faecium
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 3 - protein, 574 aa, Enterococcus faecium
MMIKKYTGDFETTTDLNDCRVWSWGVCDIDNVDNITFGLDIDSFFEWCEMQGSTDIYFHNEKFDGEFMLSWLFKNGFKWSKETKEERTFSTLISNMGQWYALEICWEVNYATTKSGKTKKEKVRTIIYDSLKKYPFPVKQIAEAFNFPIKKGEIDYTKERPVGYNPTDDEWDYLKNDIQIMAMALKIQFDQGLTRMTRGSDALGDYKDWLKATHGKSTFKQWFPILSLGFDKDLRKAYKGGFTWVNKVFQGKEIGDGIVFDVNSLYPSQMYVRPLPYGTPLFYEGEYKPNNDYPLYIQNIKVRFRLKEGYIPTIQVKQSSLFIQNEYLDSSVNKLGVDELIDLTLTNVDLELFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDRIIYCDTDSIHLVGTDVPEAIEHLVDPKKLGYWGHESTFQRAKFIRQKTYVEEIDGELNVKCAGMPDRIKELVTFDNFEVGFSSYGKLLPKRTQGGVVLVDTMFTIK

SEQ ID NO: 4 - protein, 574 aa, Enterococcus faecium
MMIKKYTGDFETTTDLNDCRVWSWGVCDIDNVDNITFGLDIDSFFEWCEMQGSTDIYFHNEKFDGEFMLSWLFKNGFKWSKETKEERTFSTLISNMGQWYALEICWEVNYATTKSGKTKKEKVRTIIYDSLKKYPFPVKQIAEAFNFPIKKGEIDYTKERPVGYNPTDDEWEYLKNDIQIMAMALKIQFDQGLTRMTRGSDALGDYKDWLKATHGKSTFKQWFPILSLGFDKDLRKAYKGGFTWVNKVFQGKEIGDGIVFDVNSLYPSQMHVRPLPYGTPLFYEGEYKPNNDYPLYIQNIKVRFRLKEGYIPTIQVKQSSLFIQNEYLDSSVNKLGVDELIDLTLTNVDLELFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDRIIYCDTDSIHLVGTDVPEAIEHLVDPKKLGYWGHESTFQRAKFIRQKTYVEEIDGELNVKCAGMPDRIKELVTFDNFEVGFSSYGKLLPKRTQGGVVLVDTMFTIK

SEQ ID NO: 5 - protein, 573 aa, Enterococcus faecium
MIKKYTGDFETTTDLNDCRVWSWGVCDIDNVDNITFGLDIDSFFEWCEMQGSTDIYFHNEKFDGEFMLSWLFKNGFKWSKETKEERTFSTLISNMGQWYALEICWEVNYTTTKSGKTKKEKVRTIIYDSLKKYPFPVKQIAEAFNFPIKKGEIDYTKERPVGYNPTDDEWDYLKNDIQIMAMALKIQFDQGLTRMTRGSDALGDYKDWLKATHGKSTFKQWFPILSLGFDKDLRKAYKGGFTWVNKVFQGKEIGDGIVFDVNSLYPSQMYVRPLPYGTPLFYEGEYKPNNDYPLYIQNIKVRFRLKEGYIPTIQVKQSSLFIQNEYLDSSVNKLGVDELIDLTLTNVDLELFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDRIIYCDTDSIHLVGTDVPEAIEHLVDPKKLGYWGHESTFQRAKFIRQKTYVEEIDGELNVKCAGMPDRIKELVTFDNFEVGFSSYGKLLPKRTQGGVVLVDTMFTIK

SEQ ID NO: 6 - protein, 572 aa, Bacteriophage M2Y
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDVNSLYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEEGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWAHESTFKRAKYLRQKTYIQDIYVKEVDGKLKECSPDEATTTKFSVKCAGMTDTIKKKVTFDNFAVGFSSMGKPKPVQVNGGVVLVDSVFTIK

SEQ ID NO: 7 - protein, 830 aa, Lucilia cuprina
MARKRPIRITKNDRAEYKRLSKNAKSKLNRTVKNYGIDLSNDVDIPKLSDFKTRKEFNDWKQKITSFTSRSNQEYQFRKNEYGVVASVKELNEIKRNTKKAQKIAKEKIDKAMKLDFYVEGERQGKVKDRIKLMKKEEVAGVSVPVDFDFDKIQTRKRLEDKAGFMEERATGDYYRKKDIQMKENFISMIEQGFNSDADEVIKKLKKIPPDDFVELTIVTDEIDFRNYGSKNEGGINDEDKLEELNNTLNDYFNETTTDVNDCRVWAYGWMEIGKTSNYKIGTDFNEFMEWMIHSSSRLYFHNLKFDGSFIVNWLLHNGYTWTKRPSKEGQFSTLISKMGQWYGITICSGRDGRKKKLTTIHDSLKKLPFPVRKIGKDFKLNVLKGDIDYHKPRPIGYEIDDEEYQYIKNDIQIIAEALEVQTVQGLTGMTNGKDALDEFVNMSGKLYEKLFPVFSLELNEEIRKAYRGGFTWLNPVYGTKKYVKDGIVFDVNSLYPSQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFRQYIDKWMLVKNMSAGAKKAIAKLMLNSLYGKFATNPDITGKRPYLREDGSNGFELMEEEFRDPVYTPVGIFITSWARYTTITSAQKCYDRIIYCDTDSMHLEGLDVPESIKDIVADDVLGYWKKEGQFKQGKFIRQKTYMEEYYAKYVRDENGEIKYDDEKPIKTICDKEESDTTIIEIKCAGMPDNIKKHVTFDNFDIGFTMEGKLKPKQVYGGVVLVEETYTMK

SEQ ID NO: 8 - protein, 589 aa, Lucilia cuprina
MKHMPRKMYSCDFETTTDVNDCRVWAYGWMEIGKTSNYKIGTDFNEFMEWMIHSSSRLYFHDLKFDGSFIVNWLLHNGYTWTKRPSKEGQFSTLISKMGQWYGITICSGRDGRKKKLTTIHDSLKKLPFPVRKIGKDFKLNVLKGDIDYHKPRPIGYEIDDEEYQYIKNDIQIIAEALEVQTVQGLTGMTNGKDALDEFVNMSGKLYEKLFPVFSLELNEEIRKAYRGGFTWLNPVYGTKKYVKDGIVFDVNSLYPSQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFRQYIDKWMLVKNMSAGAKKAIAKLMLNSLYGKFATNPDITGKRPYLREDGSNGFELMEEEFRDPVYTPVGIFITSWARYTTITSAQKCYDRIIYCDTDSMHLEGLDVPESIKDIVADDVLGYWKKEGQFKQGKFIRQKTYMEEYYAKYVRDENGEIKYDDEKPIKTICDKEESDTTIIEIKCAGMPDNIKKHVTFDNFDIGFTMEGKLKPKQVYGGVVLVEETYTMK

SEQ ID NO: 9 - protein, 592 aa, Bacillus phage VMY22
MATKKRKAYSCDFEATTSTYSETETRVWAYGWMEIGNTSHFNIGDNLDEFMLWTSKECADLYFHDLRYDGEFIVNWLLHKGYECNESGRPKTFDTVISKGGQWYKIAIHHEGKGTTQIFDSLKKLPFPVKTIAKAFKLPVLKGDIDYNLHRDENHVITSEEFTYIKHDIEIVARALDIQINQQGLVKMTNGADSMDHFIKSLDKKKKVAERIYNQYFPKMSIAMDSIFRKAYRGGFTWVNPKFKGQEVGEGMVFDVNSLYPSVMYYKPLPWGKPVPFVGKYEEDPDFPLYICHIKTGFVLKEGHIPTIQIKKNPIFQENEYLETSGGAPVDLHVTNVDLELIKEHYELYDTEYVGGWKFRQQTGIFNNFIDYWMKIKTDPKSTPAIVTLAKLQLNSLYGKFASHPDVTGKVPYLKDDGSTAFKKGLPKSKDPVYTPAGAFITAWARHMTITTAQKVYDRILYCDTDSIHILGIDIPEAIKNDIHQKELGKWAFECMFKRAKFVRQKTYVEDMYAKFMSYWEDGELNYMLKECVKEEATARLLNVKCAGMPQAVKKFVTFRTFAVGFTSDTGKLKPKHVKGGQILVDVPFTIK

SEQ ID NO: 10 - protein, 578 aa, Bacteriophage GA-1
MARSVYVCDFETTTDPEDCRLWAWGWMDIYNTDKWSYGEDIDSFMEWALNSNSDIYFHNLKFDGSFILPWWLRNGYVHTEEDRTNTPKEFTTTISGMGQWYAVDVCINTRGKNKNHVVFYDSLKKLPFKVEQIAKGFGLPVLKGDIDYKKYRPVGYVMDDNEIEYLKHDLLIVALALRSMFDNDFTSMTVGSDALNTYKEMLGVKQWEKYFPVLSLKVNSEIRKAYKGGFTWVNPKYQGETVYGGMVFDVNSMYPAMMKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGFIGFFDEYIDRFMEIKNSPDSSAEQSLQAKLMLNSLYGKFATNPDITGKVPYLDENGVLKFRKGELKERDPVYTPMGCFITAYARENILSNAQKLYPRFIYADTDSIHVEGLGEVDAIKDVIDPKKLGYWDHEATFQRARYVRQKTYFIETTWKENDKGKLVVCEPQDATKVKPKIACAGMSDAIKERIRFNEFKIGYSTHGSLKPKNVLGGVVLMDYPFAIK

SEQ ID NO: 11 - protein, 566 aa, Actinomyces phage AV-1
MVRQSTIASPARGGVRRSHKKVPSFCADFETTTDEDDCRVWSWGIIQVGKLQNYVDGISLDGFMSHISERASHIYFHNLAFDGTFILDWLLKHGYRWTKENPGVKEFTSLISRMGKYYSITVVFETGFRVEFRDSFKKLPMSVSAIAKAFNLHDQKLEIDYEKPRPIGYIPTEQEKRYQRNDVAIVAQALEVQFAEKMTKLTAGSDSLATYKKMTGKLFIRRFPILSPEIDTEIRKAYRGGFTYADPRYAKKLNGKGSVYDVNSLYPSVMRTALLPYGEPIYSEGAPRTNRPLYIASITFTAKLKPNHIPCIQIKKNLSFNPTQYLEEVKEPTTVVATNIDIELWKKHYDFKIYSWNGTFEFRGSHGFFDTYVDHFMEIKKNSTGGLRQIAKLHLNSLYGKFATNPDITGKHPTLKDNRVSLVMNEPETRDPVYTPMGVFITAYARKKTISAAQDNYETFAYADTDSLHLIGPTTPPDSLWVDPVELGAWKHESSFTKSVYIRAKQYAEEIGGKLDVHIAGMPRNVAATLTLEDMLHGGTWNGKLIPVRVPGGTVLKDTTFTLKID

SEQ ID NO: 12 - protein, 593 aa, Unknown
  Candidatus Moranbacteria
MKLKSKYVADFEATGEEQYKIDGSTHVWAVGVIDIETEETVLISNDIADFMNWLSKDNHNHKNKEVFFHNLKYDGDFIVKFLLENGFKHSRERALYSNEFSTLISDTGTWYEIKICFHALKTRKVEVKIHDSYKLLPFSEEKIAKAFKLTVSKGEIDYDRYRPVGYQLQEYEVDYLKTDLLIMAQALKVQMNKGLTKMTIGSNALADYKQRISKDKFKYLFPVLDNIIDADLRHAYRGGHTYLQPFYANKILENVHSYDKNSMHPSQMKNMPMPYGIPVYYEGEYKNDPDYPLFIQSIEIDCKVKKGYLPTIQPRNAFRFATTEFLEDTKGEPIQLFVTSIDLMLILEHYDIHYIQYLEGFKFRSHIGLFDEYIDYWYHIKETNTGPLREIAKLMLNNLYGKFGTNPIRARKEPIYDKTKGAVYVNLPAEEGDAVYIPMACFITAYSRYDLISTAQKFYKNVVYMDTDSIKFYGISREVIEAQIEVHDTKIGAWKYEGTAKMFKALRPKTYAYIDENDELDVKCAGLPKKAKKDITFDTFQYGFVSKEKLEIKRVKGGTILLKTKFEIKKQVDNKHIDTEYFEDEDIDIFNQL

SEQ ID NO: 13 - protein, 669 aa, Bacillus phage MG-B1
MKKKRTKTKIKTYACDFETNTEAWLHEDKLRDELKTKEENPELWRKREAWKLHTGGDKAFVWSWGGTEIREDMSFKGELDNFVVGKGISEYVDWMLDGSKNVWFHNLKFDGSFIAVELLRRGFKFTFDRNPAIGEFTGLIDGKKMWFELIICKEGKRGGRQFITIKDSLKKVPFGLRVAAMAFGLDVFKDDMDYDVIREPFEPIGEADYKYLKKDVEITAKIIHYQVFQSGLKKTTIGSDALNEFKSTVGGDKGFKEIFPVMDFDTDSFIRKSYFGGVTQVKPGMEGKLIGEGSVFDIVSMYPWVQYTKLLPYGLPIEYNGEYTYDEEYPLYVQQVSFSFVVKDNMLPTIQLKKQNVEFNYNEADDVRKFNGREFQKTSYGEIVTMYVTNVQWEQIQKHYWLDDLHFHKGMMFKGKIGLFKEHIDKWLKVKKQANDDGNDALKSLAKLMLNSPYGKFGTNTIRLNVEPFLWEDDESLGFRVEDDDPPPADPIYTAYASFVTAYAREELVSTIMMCYDRFVYCDTDSIHLIGTEIPEGIKHKIGGDLGDWEPESEFKLAKFHRAKTYCEMVYAKKVMKKDRWGDVVESLKHCSKEEWGTLPQDQKTLDKNLKCAGLQGHLKDYVSFEEFEIGLKINPEVNKDIMGKPLGKLMPCQVKGGTLLKVRKFSLN

SEQ ID NO: 14 - protein, 572 aa, Eggerthella sp.
MNEYISDFETQKDPDTGVMSVWAWSIVDVNDLSNIQYGNNIESWLSAIQGLPNGSLIGFHNLKFDGSYILSYLLGVAKWEYNDKPKARKAKTVECLISSIGVHYNYRINFTKRKYVKIYDTLKIFNMSVSQIAKSFGIKEQKGSIDYAIFRGYNYTMTPKEVEYITNDVKIVAKAIKQFRNEGHERNTIASNAMRYYKKNSYYSNYEFLTYFPHLDDDLYHLLKRAYKGGYCYVNPKFKGKPVGHGRVYDVNSLYPSVMSDPQNKYPIGTPVFFEGKYKDDPIYPLYIQFITAQFELKKGKIPTIQIKNDKRFNPREYVTSTGCLMVNLYLTNVDLEMFYECYNIKEIQYIGGYKFIGRSGIFIDYVNHFKEMKMQATIEKNAGKRSIAKLFLNSLYGKFGASNDKFVKRPYINDKGILAYQTVETPRPAKTVYVPVAAFVTAYARRFIQTLFIKNVDRCCYCDTDSLHLIGDDPPEGVKISDTEFNCMAHESSFSRAKFLGAKLYIEEDEQGNLDVKAAGLGQNEVVKNQITFDNFNTEQEYFGILKSKTVQGGVELSESTFKIRERGTRF

SEQ ID NO: 15 - protein, 568 aa, Bacteriophage CP-7
MTCYYAGDFETTTNEEETEVWLSCFAKVIDYDKLDTFKVNTSLEDFLKSLYLDLDKTYTETGEDEFIIFFHNLKFDGSFLLSFFLNNDIECTYFINDMGVWYSITLEFPDFTLTFRDSLKILNFSIATMAGLFKMPIAKGTTPLLKHKPDEIKPEWIDYIHVDVAILARGIFAMYYEENFSKYTSASEALTEFKRIFRKSKRKFRDFFPILDEKVDDFCRKAYRGGWTFANPKTQGRTLKQLIDIYDINSMYPATMLQNALPIGIPKRYKGKPKEIKEDHYYIYHIKADFDLKRGYLPTIQIKKKLDALRIGVRTSDYVTTSKNEVIDLYLTNFDLDLFLKHYDATIMYVETLEFQTESGLFDDYITTYRYKKENAQSPAEKQKAKIMLNSLYGKFGAKIISVKKLAYLDDKGILRFKNDDEEEVQPVYAPVALFVTSIARHFIISNAQENYDNFLYADTDSLHLFHSDSLVLDIDPSEFGKWAHEGRAVKAKYLRSKLYIEELIQEDGTTHLDVKGAGMTPEIKEKITFENFVIGATFEGKRASKQIKGGTLIYETTFKIRETDYLV

SEQ ID NO: 16 - protein, 616 aa, Bacteroides sp.
MSKKSAKKPVIIAADFETTVYPGQTSTEVWSAAWIELFTERPHVRGNIEDFLNDIFNLNKNVLCYFHNLRFDGAFIVYWLLKNGYTWNNARNKGMNAKEFKALISDTNKWYTVTVKPKFDTVIEFRDSVKLMPMTLDQIGSAFNTKHRKLEMEYIGMRHANCEITPEEYAYIINDIYVLKEALEVMIKSGHDKLTIGSCCMDEFKNKFDAMDFKAAFPNLKEIALIKYELGSDNVDQYIRKAYKGGYCYYKYKQRKHITQNGMTFDVNSLYPSVMHSKSGNYYPTGKPIFFEKAIPYKCLEARVYPFYVRLRCRFKLKDGFLPTVQIKGDYKYNSTQWLETSDIYYRGKYYRYFTNKEGQKEEARPELTLFMTDYLLLLEHYDVYDLEILDGCYFHGAIGLFDTYIDHYMKIKMTTKDKGERTEAKLFLNNLYGRLAINDNSSYREPFIDPETDSIGFELHPEHEKDTLYIAAGAAVTAYARYFTITHAQANYQNFVYSDTDSIHMLDDGQPVKMIKEHATELLHWKRESDWSSAIFIRQKTYAEFVQKEDGKKVTGHWEIKCAGMPEKSKKLFLASHPITDFKIGLKVGGKLKPKYISGGMVLVEDFYTLRAKRC

SEQ ID NO: 17 - protein, 641 aa, Chlamydia trachomatis
MKARKFKIYAADFETTVFKGQTFTEVWSACFCELYKKDAKIMHSIQDFFNYFFSLNENIKMYFHNLKFDGSFILSYLLKDLKYEQAYEKMNADGSLVRWLETKDMKNNSIKYSISEMGQWYYIIIKKNNKIIEIRDSLKLLPFSLEAIGKSFDTEHKKLKMKYEGYRYAGCEITPEEQAYIKNDVLVLKEALEIMFNEKHESLTIGSCCLNEYKTIMTKFLIERLYPNIAEYTVNVPLEFKNADEYVRKSYKGGWCYLKKGCENKIYNNGTTADVNSLYSSVMHSESGNYYPVGLPTFWSGNYIPEIAKEKYYFIRIKTRFYLKKRFLPCIQVKNTYRYKSTEWLETSDFYDKKTNKYYKKYLDINGNEQNTQVILTLTMTDFELIKEHYNLVDFEILDGCYFDKEIGLFDEYINKYKKIKLNSKGAKKTLAKLYLNNLYGKTATNTDSSFKVAYIKDDLSLGFYGVYACDKKPFYIPVGSAITSYARNFTIRAAQKNYKNFIYADTDSIHCKCNPAEIKGITIDDKKFLCWKLESCWDKGLFVRQKTYIEHITAENLKPIDKPFYNVKCAGMPEQCKTLFLKSIGEDVDISDLNINDDAKEFLKKKRTIKDFKAGLSVPLKLRPVQINGGVLLTETFYTM

SEQ ID NO: 18 - protein, 574 aa, Globodera pallida
MPLPRKKASSNGLSKRIYLADFETTTQAEDCRVWSWGLCSVENTENVEFGGDLDSFIERISEENSITFFHNLKFDGAFILDRLFRLGYEFTDEKAPQVKEFSTLISKMGQFYSIKVRWENGMFTEFRDSLKKLPMSVKQVAKTFKLDQAKGEIDYHYLRPVGWVMTPEEREYVKNDVQIVARALKVQLQEGMTRLTVGADSLAQYKSMMGKDFERHFPVLTRTIDAEIRRAYRGGWAYADERHRGKVVGAGQTFDVNSLYPSVMYSKVLPYGEPVFYPNGLPEVTEDHPLFITCITFTAKIRDGHLPCIQIKNSSLFTPTEYVKEVLDPITMYCTNVDLELWQEHYDMDILAYNGAWLFRGIRGFFNDYIDHWMRIKEESEGGRKLIAKLHLNSLYGKFATNPDVTPKIPIFDEEKDIVRLIEGPPDERNPVYTAMGVFITSYARDLTIRTAQDHYDRFLYADTDSLHLLTSDGTNNGRKSKALEVHPSKLGYWKHEYDFDAGLFVRAKAYTELMTGEFHVKSKCECDTPNDLHYQTHIAGMPEAIAQHITFESYRDGATFEGKLAPQRVPGGI

SEQ ID NO: 19 - protein, 584 aa, Unknown
  Potato cyst nematode
MPLPRKKASSNGLSKRIYLADFETTTQAEDCRVWSWGLCSVENTENVEFGGDLDSFIERISEENSITFFHNLKFDGAFILDRLFRLGYEFTDEKAPQVKEFSTLISKMGQFYSIKVRWENGMFTEFRDSLKKLPMSVKQVAKTFKLDQAKGEIDYHYLRPVGWVMTPEEREYVKNDVQIVARALKVQLQEGMTRLTVGADSLAQYKSMMGKDFERHFPVLTRTIDAEIRRAYRGGWAYADERHRGKVVGAGQTFDVNSLYPSVMYSKVLPYGEPVFYPNGLPEVTEDHPLFITCITFTAKIRDGHLPCIQIKNSSLFTPTEYVKEVLDPITMYCTNVDLELWQEHYDMDILAYNGAWLFRGIRGFFNDYIDHWMRIKEESEGGRKLIAKLHLNSLYGKFATNPDVTPKIPIFDEEKDIVRLIEGPPDERNPVYTAMGVFITSYARDLTIRTAQDHYDRFLYADTDSLHLLTSDGTNNGRKSKALEVHPSKLGYWKHEYDFDAGLFVRAKAYTELMTGEFHVKSKCECDTPNDLHYQTHIAGMPEAIAQHITFESYRDGATFEGKLAPQRVPGGIVLVDDTFTIK

SEQ ID NO: 20 - protein, 548 aa, Lynx pardinus
  misc_feature (339)..(374): Xaa can be any naturally occurring amino acid
MPSYTADFETTTVADDCRVWAWATSRIGNPDDVQLGNSIDTFLEWCRVHSGSRVYFHNLKFDGKFILHKILTDGWKWIPDKNDCANRTFTTLISDMSQFYSIKLWFDESKSIEFLDSLKVIPLPIAAIPKAFGLEIEKLDLDYQASREVGHELTEDEKEYIAHDVKIAAMAMDTMFSQGMKKITAGSNAFADYKKTIGGKKRFRDWFPEPEYDEDLRKGGCYKGGFTAVNPKIAGKKLGKGVSFDVNSLYPSVMASSHGEVLPYGEPIPYDGGYEQDEDHPLYIQFIEADFAVKENRIPCLQLKGNVMFGETEYIRDSKGMQTLCLTSVDMEMLFEHYXXXXXXXXXXXXXXXXXXXXXXXXXXXXXXXXXXXXRTIAKLQLNSLFAANPVKQSRMPYLDEGIVKYALLEPEHAEAQYLPAGAFITSYARQFTIRAAQANYERWLYCDTDSVYLRGTEPPVDMRVDAYELGAWKKEHEFDCFKAIRAKTYCFEEDGELTVHCAGMPARCHEHVTMDNFEVGASFPGKLKPKDVNGGTILVEDVFTIRP

SEQ ID NO: 21 - protein, 573 aa, Enterococcus faecium; identical to SEQ ID NO: 5

SEQ ID NO: 22 - protein, 608 aa, Unknown
  Bacillus phage Harambe
MGNKKRKIYSCDFETTTDVNDCRVWAYGLMEIDGKFENYKEGNNIDEFMEWTEQEQGDLYFHNLRFDGEFIVNWLLHKGYRFNNTRKAGTFNAVISSMGQWYKIDIYYGREGKKVFKTSIYDSLKKLPFPVKTIAKAFKLPIEKGDIDYDAPRPVGHQITPDESKYIKNDVEIIARALHSQLNTAKLTKMTIGSDALDGFKHSLHKSPKVSKRMYDHHFPVISNAIHEEFKKAYRGGFTWANPKYAGKVIGNGLVFDVNSLYPSVMYDKPLPYGLPVPFSGEYEYDETHPLFIQHIKCGFELKDGHIPTIQIKKNFRFADNEYLHSSEGNILDLHVTNVDLALIKEHYTLYEEEYLQGYKFKQVTGLFKNYIDYWSDKKINAEDPAIRQMAKLMLNSLYGKFGTSIDVTGKEVFLKEDGSTGFRKGQKEERDPVYMPMGAFITAYARDVTIRTAQKCYDRILYCDTDSIHLVGTEIPEAIKDRIHDKKLGYWAHESTFWRAKFIRQKTYIEDLCMRFEGEKVNGEWKFKMVEEKDITKATARELSVKCAGMPAQVKQYVTFDNFGVDFKHDPNDYTDEEIKRKNIKFKLKPTHRKGGQVLVPTPFTIK

SEQ ID NO: 23 - protein, 572 aa, Bacteriophage B103
MPRKMFSCDFETTTKLDDCRVWAYGYMEIGNLDNYKIGNSLDEFMQWVMEIQADLYFHNLKFDGAFIVNWLEHHGFKWSNEGLPNTYNTIISKMGQWYMIDICFGYKGKRKLHTVIYDSLKKLPFPVKKIAKDFQLPLLKGDIDYHAERPVGHEITPEEYEYIKNDIEIIARALDIQFKQGLDRMTAGSDSLKGFKDILSTKKFNKVFPKLSLPMDKEIRRAYRGGFTWLNDKYKEKEIGEGMVFDVNSLYPSQMYSRPLPYGAPIVFQGKYEKDEQYPLYIQRIRFEFELKEGYIPTIQIKKNPFFKGNEYLKNSGAEPVELYLTNVDLELIQEHYEMYNVEYIDGFKFREKTGLFKEFIDKWTYVKTHEKGAKKQLAKLMFDSLYGKFASNPDVTGKVPYLKEDGSLGFRVGDEEYKDPVYTPMGVFITAWARFTTITAAQACYDRIIYCDTDSIHLTGTEVPEIIKDIVDPKKLGYWAHESTFKRAKYLRQKTYIQDIYAKEVDGKLIECSPDEATTTKFSVKCAGMTDTIKKKVTFDNFRVGFSSTGKPKPVQVNGGVVLVDSVFTIK

SEQ ID NO: 24 - protein, 572 aa, Bacteriophage phi-29
MPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 25 - protein, 608 aa, Unknown
  Bacillus phage (Beechbum)
MGNKKRKIYSCDFETTTDVNDCRVWAYGLMEIDGKFENYKEGNNIDEFMEWAEKEQGDLYFHNLRFDGEFIVNWLLHKGYRFNNTRKAGTFNAVISSMGQWYKIDIYYGREGKKVFKTSIYDSLKKLPFPVKTIAKAFKLPIEKGDIDYDAPRPVGHQITPDESKYIKNDVEIIARALHSQLNTAKLTKMTIGSDALDGFKHSLHKSPKVSKRMYDHHFPVISNAIHEEFKKAYRGGFTWANPKYAGKVIGNGLVFDVNSLYPSVMYDKPLPYGLPVPFSGEYEYDETHPLFIQHIRCGFELKEGHIPTIQIKKNFRFADNEYLHSSEGNILDLHVTNVDLALIKEHYTLYEEEYLQGYKFKQVTGLFKNYIDYWSDKKINAEDPAIRQMAKLMLNSLYGKFGTSIDVTGKEVFLKEDGSTGFRKGQKEERDPVYMPMGAFITAYARDVTIRTAQKCYDRILYCDTDSIHLVGTEIPEAIKDRIHDKKLGYWAHESTFWRAKFIRQKTYIEDLCMRFEGERVNGEWKFKMVEEKDITKATARELSVKCAGMPAQVKQYVTFDNFGVDFKHDPNDFTEEEIKRKNIKFKLKPTHRKGGQVLVPTPFTIK

SEQ ID NO: 26 - protein, 579 aa, Unknown
  Bacillus phage (Karezi)
MSRNRPVYVADFEATTDPNDCRVWAWGVMDIYNQENWTYDHDIQSFINWLSSSNCEMYFHNLKYDGSFIVNWLLHNGFTHVEDEPKQKFQFSTVISGMGQWYVIEINFGWVNRKKSIVKIYDSLKKLPFKVSQIAKGFKLDQLKGDIDYHKPRPIGYVMDKEELDYLYNDLKIVADALVIQFEQGLDKMTNGSDALAGFKDIIGKKGYEKLFPVYDLELNEQVRMAYRGGFTWVNPKFQGQPIDGGRVYDVNSMYPAMMMYKELPVGMPQIFFGEYEYDPEYPLYIQHLRCYFDVKEDHIPCIQIKGHVFFKKNEYITSTQDHYVDLYVTNVDLELIKDHYNLTDVEYVKGYKFRSQTGIFKDYIEKWMEVKSSPDSTAAQVILAKLMLNSLYGKFATNPNVTGKVPYLKENGALAFRKGEESFRDPIYTPMGCFITAYARENVIRTAQKLQHRFIYADTDSIHVAGLEEAEAIADQIHPSKLGYWDHETTFEKAMYLRQKTYFLVTCSKENEKGKLIPALPSEATNRKNKIACAGMNDTIKGKVTFEEFRIGFKSNGSLKPKQVFGGVVLMDQPFEIK

SEQ ID NO: 27 - protein, 553 aa, Unknown
  HBM70020.1
MRFTADFETTTDPNDCRVWAWGLCLIDDIDIFYYGTTIDSFMDFLKEHNEITHLYFHNLKFDSEFIIYWLYHHNFKYVKDKRDVVCKSFSTLISDKGQFFSMEIGITMQRTVKIFDSLKVLPFSIAKIADAFHLPFSKLEIDYNAYRAPDHKLKDEEIKYIRGDVTIAALALKQLFSQNMKKMTTASNAMAEYREIVGESTFNKWYPVPVYDADIRQSYRGGFTYLAERYADKDIKEGIVLDVNSLYPSVMYYSPLPFGEGIYFEGKYEQDKEYNLYTQTFSCMFELKEGYIPTVQIKGSLAFVPTEYLKSSGDEYVTMTMTNVDLEMFLEHYEVYDIDYHCGWKFKSTTGLFKDYIDKWNGVKVQATIEKNGGLRTIAKLMLNSLYGKFALNPKVASKIPYLGEDDVIHYYVTDIEEREPIYIPVGTFITAWARHKTITSAQSVYDRFIYADTDSLHLEGLEEPKGLEISDTKLGAWKKESVFTRARFLRQKSYMEEIDGKLKITCAGMPPACYPYVTWDNFHIGATYPFRLRPMHTQGGIVLVNAPFTIRK

SEQ ID NO: 28 - protein, 570 aa, Clostridium beijerinckii
MIATADFETTTLENDCRVWAYAICEIGNYDNFICGNSIDDFFEFCMDKYENHILYFHNLKFDGEFIFYWLFRNGYEHVEDRKQLESKTFTTLISDKGQFYSIEICFTKKGKKTNKLTIYDSLKILNFSVQKIGKDFNLPVLKIDKEQEFYTKFREVGHILTEEEKQYIQNDVEVVARALKELFDREMNKMTIGADALNNYKVMTGKATFEKMFPILDNETDKNIRASYRGGFTFLNEKYKNKAVANGIVLDVNSLYPWVMYECPLPFGEPIYFEGKYKQDKIYNLYIQHFKCQFELKKGYIPTLQLKHNLAFIPTEYVKDSGTEEVILTLTSVDLELFLEHYNVYNVEWISGYKFKSSTEMFKSYVDFWINEKINAKKEHNGAMYTLAKLMLNSLYGKFALSPVVRGKFPLYDEKEDFIHYKYSQEESRKPIYIPVGTFITSWARNKTIRSAQKNYDRFIYADTDSLHLEGLEIPEELQIDDYILGAWKHELTFSKAKYLRAKSYMEYGKEPNTDDEEKWKITVAGMPTNCYQYVDFENFKVGAVYKGKLQHHRVSGGVILKETEFTIKM

SEQ ID NO: 29 - protein, 593 aa, Unknown
  Succinivibrio sp. (DBY31_07615)
MILTADFETTTEAPARVWAIGLCEIANPDIFIYGNSIDWLFDWLINSEESHTLYFHNLRFDGQFILFYLFTHGYEWTDEKNLKQGQFKTLISDMGMFYSITVCFEDGGKDDKKEVTFLDSLKILNFSVKQIAKGFGLPIMKGEIDYKAERPVGHILTQEEVDYLRNDVQIVAMALAVLFKQGLKKMTAGSNAFHDFKTTFGKKHFEKMFPIPENDKEIRKAYKGGFTYLNPAFAEKEVFDGHVFDVNSLYPSVMYFKMMPFGVPVRFTGRYEDDKLYPLYVQRIKCQFELKPGKIPTIQLKGNLAFIPTQYLSDSGDEIVEMTLTNVDLKLFFEQYEVYNIEYLDGFKFMGAYDLFKDYIDKWTAVKIGSTKTKNAAMRSLAKLMLNSLYGKFSLNPKVQSKVPYFDRVNKVVKYKLGPEEEREPIYIPVGAFITAYAREVTIRASQAIKDLSIKKYGKDMYIYSDTDSIHTLLPVEDVETIIETSDTELGKWAHESDFVAGKFLHQKCYCEAEIVSDEEYESLLADEETRSRCTIFDGVKTFLKVTCAGMSSGCYKYVTWENFRTGEAFKGKLLHNNVEGGAILKEVDFTIK

SEQ ID NO: 30 - protein, 559 aa, Unknown
  Firmicutes bacterium (DBX59_10140)
MRSYTFDFETTTDPEDCRVWAYGIYSIDDDRYITDGNSIEGFIEWLECAANCKGYFHNLGFDGVFIIDHLLKSGWLWVGSKQKATDRTFTTLISDMNQVYQITLYFTKTRYVTIQDSLKIIPLSVEAMAKAYGLEIRKGSIDYDEYREPGHEITDDERAYLVNDVAIVAKSLRTFFEQKLTKMTAGSNALFDYKRRLGGHRKFRNVFPLLSEEEDAFIRKAYRGGFTYVNPKFQGRDVGEGIVFDVNSLYPSVMAACDGQFLPYGKPVWFDGVPQPTERHPLWIACVLCSFKGRKEHIPCLQLKGNMMFKQTEYVEDSQGRVCITVTNVDWELMNKQYHVWDVEFIGGYMFHASPHMFQDYVCKWVDIKNQATISGNGGLRSLAKLMLNSLYGKFATRTTVKSRKPVLVDGVVHYVDLEPEQRDGVYLPCGVFITSYARYKTITSAQSVYDRFIYADTDSLHLVGTDIPDCLDVDAVRLGAWKHESTFDHGKFLRAKTYVEHEVGADELTVHVAGLPARCHENVTLENFEFGAVYEGNLTARKVPGGVVLYEGTKEIRS

SEQ ID NO: 31 - protein, 598 aa, Unknown
  Arthrobacter phage Anjali
MRFIPAFLARFVGAIMGGRKQAQYVADFETTTDPDDCRVWAYGLANINTADSLWDVEIGPSIHRFFDRMSEEDSVCYFHNLKFDGEFIFWQLFKEGYVHVKDRPHRPGQFSTLISSMGSFYSITVRWKNGKKTEFRDSLKKLPYSVAVVAKAFNQPEQKGDLDYAAYRAPGHIPTAAERAYIAADVLIVARALKTQFDQGMTKLTVGSDSLAEFKKITGTRLYDKLFPVLPDEMDAEIRAAYRGGFTYADTRFRGKVTRGGITYDVNSLYPSVMYDRVLPYGEPIYAPGLPSPTREYPLFIVSLTFTAKLKPGHIPCIQVKGSSHFLATEYQTEITEPVTISCTNVDLELWEDHYDLDILSYNGGWLFRGVSGLFTEFIDKWMDVKANNEGGLRALAKLQLNALYGKFGTNPNITPKEPVYDPDTNTVRLVLGDEETKDPIYTAMACFVTAYARDVTIRAAQDNYPHFAYADTDSLHLLIDDDPIGLDVDPHKLGAWKREYRFEAGLFVRAKAYIERLPSPTHEPEDCPLVGQDFGIRDKHGEWCRHVTHVAGMPDRIGARLTIPDFQEGKKFRGKLQPKRVPGGIVLEDIGFTLKMS

SEQ ID NO: 32 - protein, 590 aa, Unknown
  Arthrobacter phage Mendel
MRFIPAFLARFVGAIMGGRKQAQYVADFETTTDPDDCRVWAYGLANINTADSLWDVEIGPSIHRFFDRMAEEDSVCYFHNLKFDGEFIFWQLFKEGYVHVKDRPHRAGQFSTLISSMGSFYSITVRWKNGKKTEFRDSLKKLPYSVAVVAKAFNQPEQKGDLDYTAYRAPGHIPTAAERAYIAADVLIVARALKTQFDQGMTKLTVGSDSLAEFKKLTGTRLYDKLFPVLPDEMDAEIRAAYRGGFTYADTRFRGRVTRGGITYDVNSLYPSVMYDRVLPYGEPIYAPGLPSPTREYPLFIVSLTFTAKLKPGHIPCIQVKGSSHFLATEYQTEITEPVTISCTSVDLQLWEDHYDLDILSYNGGWLFRGASGFFTDFIDKWMDVKANNDGGLRALAKLQLNSLYGKFGTNPNVTPKEPVYDPDTNTVRLVLGDEETKDPIYTAMACFVTAYARDVTIRAAQDNYPHFAYADTDSLHLLIDDDPIGLDVDPHKLGAWKREYRFEAGLFVRAKAYIERLPSPTHDPEDCPLDRHGEHCRHVTHVAGLPDRIGAYLTIADFKEGNRFTGKLQPKRVPGGIVLEDVGFTMKMS

SEQ ID NO: 33 - protein, 564 aa, Unknown
  Podoviridae sp.
MKDSYIYAADFETTTDASDCRVWAWCCTNINEPDNCTIGTSIESFNKHVNKLGSVIIYFHNLKFDGMFLLDYWLRRGYIHRTDKELNDNEFSTLISDSGQWYAMKQRIKSNIVEYRDSLKIIPIPIEEFSKTFNIPEQKLEINYSEFRCVNHELTEAEINYIKSDTIILAKALKIMISRGFNRLTCGSNAYYNYKSMTPGFSKLFPVLAQYVDRDIRKSYKGGWTYLNKEYRNKKVFSGEVYDVNSMYPWAMKYCALPYGNPVRFSGEYKKSEIYNLYVVEIECEFKLKKGKFPSIQIKNSIFYSETEYIEESEDITTLILTSVDLELFFECYDVNIYKWCGGYAFKSKVGLFSDYIDYWYNIKSQSKIDGNKGYEFIAKRMLNSLYGKYGSRGEGRSKIPYLDDGVVRFKLSELENRKAGYVPVASFITSYCRDKIIRAANSIGSRFIYADTDSIHILAGEKPNIDIDEYRLGAFKLESRFIRAKFIRQKTYMEIDDCVDVNGNHIELKNIKCAGMPKKIQKRVDEIDFCEGSVFNGKLLPEVVPGGVILKETTFEIKGSKKS

SEQ ID NO: 34 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 35 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 36 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 37 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 38 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 39 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 40 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 41 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 42 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 43 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 44 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 45 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 46 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 47 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 48 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 49 - protein, 573 aa, Artificial Sequence
  Synthetic Polypeptide
MIKRYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 50 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKKLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 51 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRDKTYVEEIDGELNVKCAGMPDRIKELVTFDNFEVGFSSYGKLLPKRTQGGVVLVDTMFTIK

SEQ ID NO: 52 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 53 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDLKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 54 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELITLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 55 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVGELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 56 - protein, 573 aa, Artificial Sequence
  Synthetic Polypeptide
MIKKYTGDFETTTDLNDCRVWAWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 57 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEPRTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 58 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKATYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 59 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWGVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 60 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKVRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 61 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLVGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 62 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDPKKLGYWKHESTFQRAKFIRQKTYVEEIDGELNVKCAGMPDRIKELVTFDNFEVGFSSYGKLLPKRTQGGVVLVDTMFTIK

SEQ ID NO: 63 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKKIAKAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWKHESTFQRAKFIRQKTYVEEIKGELNVKCAGMPDRIKELVTFDNFEVGFSSYGKLLPKRTQGGVVLVDTMFTIK

SEQ ID NO: 64 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWKHESTFQRAKFIRQKTYVEEIDGKLNVKCAGMPDRIKELVTFDNFEVGFSSYGKLLPKRTQGGVVLVDTMFTIK

SEQ ID NO: 65 - protein, 573 aa, Artificial Sequence
  Synthetic Polypeptide
MIKKYTGDFETTTDLNDCRVWAWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKERHIPTIQVKQSSLFIQNEYLESSVNKLGVGELITLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWKHESTFQRAKFIRQKTYVEEIDGKLNVKCAGMPDRIKELVTFDNFEVGFSSYGKLLPKRTQGGVVLVDTMFTIK

SEQ ID NO: 66 - protein, 573 aa, Artificial Sequence
  Synthetic Polypeptide
MIKRYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKKIAKAFNFPIKKGEIDYTKERPIGYNPTDDEWDYLKNDIQIMAMALKIQFDQGLTRMTRGSDALGDYQDWVKTTYGKSRFKQWFPVLSLGFDKKLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRDKTYVEEIKGELNVKCAGMPDRIKELVTFDNFEVGFSSYGKLLPKRTQGGVVLVDTMFTIK

SEQ ID NO: 67 - protein, 573 aa, Artificial Sequence
  Synthetic Polypeptide
MIKRYTGDFETTTDLNDCRVWSWGVCDIDNVDNITFGLEIDSFFEWCEMQGSTDIYFHDLKFDGEFMLSWLFKNGFKWCKEAKEERTFSTLISNMGQWYALEICWNVKCTTTKTGKTKKEKQRTIIYDSLKKYPFPVKKIAKAFNFPIKKGEIDYTKERPIGYNPTDDEWDYLKNDIQIMAMALKIQFDQGLTRMTRGSDALGDYQDWVKTTYGKSRFKQWFPVLSLGFDKKLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRDKTYVEEIKGELNVKCAGMPDRIKELVTFDNFEVGFSSYGKLLPKRTQGGVVLVDTMFTIK

SEQ ID NO: 68 - protein, 573 aa, Artificial Sequence
  Synthetic Polypeptide
MIKRYTGDFETTTDLNDCRVWAWGVCDIDNVDNITFGLEIDSFFEWCEMQGSTDIYFHDLKFDGEFMLSWLFKNGFKWCKEAKEPRTFSTLISNMGQWYALEICWGVKCTTTKTGKTKKEKVRTIIYDSLKKYPFPVKQIAKAFNFPKKKGEIDYTKERPIGYNPTPDEWDYLKNDIQIMAMALKIQFDQGLTRMTRGSDALGDYQDWVKATYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLVGTKVPEAIEHLVHPKKLGYWEHESTFQRAKFIRDKTYVEEIKGKLNVKCAGMPDRIKELVTFDNFEVGFSSYGKLLPKRTQGGVVLVDTMFTIK

SEQ ID NO: 69 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 70 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 71 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 72 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 73 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGELNVKCAGMPDRIKELVTFDNFEVGFSSYGKLLPKRTQGGVVLVDTMFTIK

SEQ ID NO: 74 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 75 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGELNVKCAGMPDRIKELVTFDNFEVGFSSYGKLLPKRTQGGVVLVDTMFTIK

SEQ ID NO: 76 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 77 - protein, 573 aa, Artificial Sequence
  Synthetic Polypeptide
MIKKYTGDFETTTDLNDCRVWAWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELITLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGELNVKCAGMPDRIKELVTFDNFEVGFSSYGKLLPKRTQGGVVLVDTMFTIK

SEQ ID NO: 78 - protein, 573 aa, Artificial Sequence
  Synthetic Polypeptide
MIKKYTGDFETTTDLNDCRVWAWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELITLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 79 - protein, 573 aa, Artificial Sequence
  Synthetic Polypeptide
MIKKYTGDFETTTDLNDCRVWAWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELITLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGELNVKCAGMPDRIKELVTFDNFEVGFSSYGKLLPKRTQGGVVLVDTMFTIK

SEQ ID NO: 80 - protein, 573 aa, Artificial Sequence
  Synthetic Polypeptide
MIKKYTGDFETTTDLNDCRVWAWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELITLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 81 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGELNVKCAGMPDRIKELVTFDNFEVGFSSYGKLLPKRTQGGVVLVDTMFTIK

SEQ ID NO: 82 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 83 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGELNVKCAGMPDRIKELVTFDNFEVGFSSYGKLLPKRTQGGVVLVDTMFTIK

SEQ ID NO: 84 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 85 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWKYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 86 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKKIAEAFNFPKKKGEIDYTKERPIGYNPTDDEWKYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGKLNVKCAGMPDRIKKLVTFDNFEVGFSSYGKLLPKRTQGGVVLVDTMFTIK

SEQ ID NO: 87 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKKIAEAFNFPKKKGEIDYTKERPIGYNPTDDEWKYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 88 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 89 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTPDEWKYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGKLNVKCAGMPDRIKKLVTFDNFEVGFSSYGKLLPKRTQGGVVLVDTMFTIK

SEQ ID NO: 90 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTPDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 91 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWKYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 92 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKKIAEAFNFPKKKGEIDYTKERPIGYNPTPDEWKYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 93 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTPDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGKLNVKCAGMPDRIKKLVTFDNFEVGFSSYGKLLPKRTQGGVVLVDTMFTIK

SEQ ID NO: 94 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPKKKGEIDYTKERPIGYNPTPDEWKYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 95 - protein, 568 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 96 - protein, 598 aa, Artificial Sequence
  Synthetic Polypeptide
MHHHHHHHHHHDYDIPTTENLYFQGMIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 97 - protein, 598 aa, Artificial Sequence
  Synthetic Polypeptide
MHHHHHHHHHHDYDIPTTENLYFQGMIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 98 - protein, 598 aa, Artificial Sequence
  Synthetic Polypeptide
MHHHHHHHHHHDYDIPTTENLYFQGMIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 99 - protein, 598 aa, Artificial Sequence
  Synthetic Polypeptide
MHHHHHHHHHHDYDIPTTENLYFQGMIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 100 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKKIAEAFNFPKKKGEIDYTKERPIGYNPTDDEWKYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 101 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 102 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTPDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGKLNVKCAGMPDRIKKLVTFDNFEVGFSSYGKLLPKRTQGGVVLVDTMFTIK

SEQ ID NO: 103 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFTVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 104 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 105 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDKLIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 106 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGVLNVKCAGMPDRIKKLVTFDNFEVGFSSYGKLLPKRTQGGVVLVDTMFTIK

SEQ ID NO: 107 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFTVKEIAKAFNFPKKKGEIDYTKERPIGYNPTDDEWKYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 108 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWKYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 109 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWKYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDKLIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKELVTFDNFEVGFSSYGKLLPKRTQGGVVLVDTMFTIK

SEQ ID NO: 110 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWKYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGVLNVKCAGMPDRIKELVTFDNFEVGFSSYGKLLPKRTQGGVVLVDTMFTIK

SEQ ID NO: 111 - protein, 573 aa, Artificial Sequence; identical to SEQ ID NO: 88
  Synthetic Polypeptide

SEQ ID NO: 112 - protein, 573 aa, Artificial Sequence; identical to SEQ ID NO: 88
  Synthetic Polypeptide

SEQ ID NO: 113 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 114 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 115 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 116 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSAYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 117 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 118 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSMYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 119 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSMYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 120 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSMYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 121 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSLYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 122 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 123 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSLYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 124 - protein, 591 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEDIYAKRVRGYLIECSPDEATTTKLNVKCAGMPDRIKKLVTFDNFEVGFSSYGKLLPKRTQGGVVLVDTMFTIK

SEQ ID NO: 125 - protein, 591 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEDIYMKRVRGYLVQGSPDDYTDIKLNVKCAGMPDRIKKLVTFDNFEVGFSSYGKLLPKRTQGGVVLVDTMFTIK

SEQ ID NO: 126 - protein, 573 aa, Artificial Sequence
  Synthetic Polypeptide
MIKKYTGDFETTTDLNDCRVWAWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 127 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELITLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 128 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 129 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 130 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEPRTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 131 - protein, 573 aa, Artificial Sequence
  Synthetic Polypeptide
MIKKYTGDFETTTDLNDCRVWAWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELITLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 132 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWKHESTFQRAKFIRQKTYVEEIKGKLNVKCAGMPDRIKKLVTFDNFEVGFSSYGKLLPKRTQGGVVLVDTMFTIK

SEQ ID NO: 133 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 134 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPIKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 135 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 136 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 137 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGKLNVKCAGMPDRIKKLVTFDNFEVGFSSYGKLLPKRTQGGVVLVDTMFTIK

SEQ ID NO: 138 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 139 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIK

SEQ ID NO: 140 - protein, 573 aa, Artificial Sequence; identical to SEQ ID NO: 138
  Synthetic Polypeptide

SEQ ID NO: 141 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIK

SEQ ID NO: 142 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 143 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSMFIQNEYLESSVNKLGVDELIDLTLTNVDLDLFFEHYDILEIHYTYGYMFKASCDMFKGWIDKWSEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIK

SEQ ID NO: 144 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 145 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 146 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 147 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 148 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSMYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 149 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSMYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 150 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSMYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 151 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSLYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 152 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 153 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSLYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 154 - protein, 611 aa, Artificial Sequence
  Synthetic Polypeptide
MIKKYTGDFETTTDLNDCRVWAWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 155 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELITLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 156 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 157 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 158 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEPRTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 159 - protein, 611 aa, Artificial Sequence
  Synthetic Polypeptide
MIKKYTGDFETTTDLNDCRVWAWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELITLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 160 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWKHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 161 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 162 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPIKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 163 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 164 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 165 - protein, 611 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGKLNVKCAGMPDRIKKLVTFDNFEVGFSSYGKLLPKRTQGGVVLVDTMFTIKGHHHHHHHHHHGGGSGGGSGGGSGLNDFFEAQKIEWHE

SEQ ID NO: 166 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 167 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 168 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 169 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 170 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 171 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSMYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 172 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSMYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 173 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSMYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 174 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSLYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 175 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 176 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSLYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 177 - protein, 638 aa, Artificial Sequence
  Synthetic Polypeptide
MIKKYTGDFETTTDLNDCRVWAWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 178 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELITLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 179 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVGELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 180 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 181 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEPRTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 182 - protein, 638 aa, Artificial Sequence
  Synthetic Polypeptide
MIKRYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 183 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRDKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 184 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKKLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 185 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWKHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 186 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 187 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPIKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 188 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 189 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 190 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIDGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 191 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 192 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 193 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 194 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 195 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWSEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 196 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDDTFTIKGHHHHHHHHHHGGGSGGGSGGGSGLNDFFEAQKIEWHEGGGSGGGSGGGSGLNDFFEAQKIEWHE

SEQ ID NO: 197 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDSVFTIKGHHHHHHHHHHGGGSGGGSGGGSGLNDFFEAQKIEWHEGGGSGGGSGGGSGLNDFFEAQKIEWHE

SEQ ID NO: 198 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLAKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 199 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGSFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 200 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEERLRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 201 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAYGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 202 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRWTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 203 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 204 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEEYRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 205 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEEERDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 206 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHEATFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 207 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWARYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 208 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 209 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 210 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGKLNVKCAGMPDRIKKLVTFDNFEVGFSSYGKLKPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 211 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 212 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 213 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 214 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 215 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 216 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 217 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 218 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 219 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 220 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 221 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 222 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 223 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 224 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 225 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 226 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 227 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 228 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 229 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 230 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 231 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 232 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 233 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 234 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 235 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 236 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 237 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 238 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 239 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 240 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 241 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 242 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSHYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 243 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDLNSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 244 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVKSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 245 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVASKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 246 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVSSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 247 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 248 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 249 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWSEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 250 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDLNSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 251 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDVNSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 252 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 253 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 254 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 255 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 256 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 257 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 258 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 259 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 260 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 261 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 262 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 263 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 264 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 265 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 266 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKLPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPAQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAYGRWTTITTAQRCFDNIIYCDTDSIHLTGTKVPEAIEHLVDSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 267 - protein, 638 aa, Artificial Sequence; identical to SEQ ID NO: 250
  Synthetic Polypeptide

SEQ ID NO: 268 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVKSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 269 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVASKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 270 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVSSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 271 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 272 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWFEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 273 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDINSAYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWSEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 274 - protein, 638 aa, Artificial Sequence; identical to SEQ ID NO: 251
  Synthetic Polypeptide

SEQ ID NO: 275 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGENGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 276 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVGLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 277 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGENGIVGLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 278 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNTGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 279 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDKIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 280 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAQAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 281 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFKFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 282 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKKIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 283 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKQIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 284 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYRDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 285 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYKDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 286 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDRIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 287 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIGNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 288 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPVITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 289 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKRSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 290 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSRLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 291 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFKQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 292 - protein, 638 aa, Artificial Sequence; identical to SEQ ID NO: 287
  Synthetic Polypeptide

SEQ ID NO: 293 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKRSRLFKGNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 294 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYTPLASFVAAYGRWTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 295 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYTPMGVFITAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 296 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFKVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 297 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCYDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 298 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGWLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 299 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFRQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 300 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIARAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 301 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKRLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 302 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIYVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 303 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCGMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 304 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIKGYLNVKCAGMPARIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 305 - protein, 638 aa, Artificial Sequence
  Synthetic Polypeptide
MIKKYTGDFETTTDLNDCRVWSWGVCDIDNVDNITFGLEIDSFFEWCEMQGSTDIYFHNLKFDGEFMLSWLFKNGFKWCKEAKEERTFSTLISNMGQWYALEICWNVKCTTTKTGKTKKEKQRTIIYDSLKKYPFPVKEIAKAFNFPKKKGEIDYTKERPIGYNPTDDEWDYLKNDIQIMAMALKIQFKQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKEGHIPTIQVKQSSLFIQNEYLESSVNKLGVDELIDLTLTNVDLDLFFEHYDILEIHYTYGYMFKASCDMFKGWIDKWIEVKNTTWGARKANAKGMLNSLYGKFGTNPDITGKVPYMGEDGIVRLTLGEEELRDPVYVPLASFVTAWGRYTTITTAQRCFDNIIYCDTDSIHLTGTKVPEAIEHLVHSKKLGYWEHESTFQRAKFIRQKTYVEEIRGYLNVKCAGMPDRIKKLVTFDNFEVGFSSYGKLLPKRTQGGVVLVDTMFTIKGHHHHHHHHHHGGGSGGGSGGGSGLNDFFEAQKIEWHEGGGSGGGSGGGSGLNDFFEAQKIEWHE

SEQ ID NO: 306 - protein, 572 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDIHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDVNSLYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEEGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWEHESTFKRAKYLRQKTYIQDIYVKEVDGKLKECSPDEATTTKFSVKCAGMTDTIKKKVTFDNFAVGFSSMGKPKPVQVNGGVVLVDSVFTIK

SEQ ID NO: 307 - protein, 572 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDIHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDANSAYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEEGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWEHESTFKRAKYLRQKTYIQDIYVKEVDGKLKECSPDEATTTKFSVKCAGMTDTIKKKVTFDNFAVGFSSMGKPKPVQVNGGVVLVDSVFTIK

SEQ ID NO: 308 - protein, 572 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDIHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDANSAYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEYGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWEHESTFKRAKYLRQKTYIQDIYVKEVDGYLKECSPDEATTTKFSVKCAGMTDTIKKKVTFDNFAVGFSSMGKPKPVQVNGGVVLVDSVFTIK

SEQ ID NO: 309 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDANSAYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEYGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWEHESTFKRAKYLRQKTYIQDIYVKEVDGYLKECSPDEATTTKFSVKCAGMTDTIKKKVTFDNFAVGFSSMGKPKPVQVNGGVVLVDSVFTIK

SEQ ID NO: 310 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 311 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 312 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 313 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDIHTERPVGHEITPEEYEYIKNDIEIIARALDIQFKQGLDRMTAGSDSLKGFKDILSTKKFNKVFPKLSLPMDKEIRKAYRGGFTWLNDKYKGKEIGEGMVFDINSAYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEYGAKKQLAKLMLNSLYGKFASNPDVTGKVPYLKDDGSLGFRVGDEEYKDPVYTPMGVFITAWGRFTTITAAQACYDRIIYCDTDSIHLTGTEVPEIIKDIVDPKKLGYWEHESTFKRAKYLRQKTYIQDIYVKEVKGYLKQCSPDEATTTKFSVKCAGMTDTIKKKVTFDNFAVGFSSMGKPKPVQVNGGVVLVDSVFTIK

SEQ ID NO: 314 - protein, 589 aa, Artificial Sequence
  Synthetic Polypeptide
MKHMPRKMYSCDFETTTDVNDCRVWAYGWMEIGKTSNYKIGTDFNEFMEWMIHSSSRLYFHDLKFDGSFIVNWLLHNGYTWTKRPSKEGQFSTLISKMGQWYGITICSGRDGRKKKLTTIHDSLKKLPFPVRKIGKDFKLNVLKGDIDIHKPRPIGYEIDDEEYQYIKNDIQIIAEALEVQTVQGLTGMTNGKDALDEFVNMSGKLYEKLFPVFSLELNEEIRKAYRGGFTWLNPVYGGKKYVKDGIVFDANSAYPSQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFRQYIDKWMLVKNMSYGAKKAIAKLMLNSLYGKFATNPDITGKRPYLREDGSNGFELMEEEFRDPVYTPVGIFITSWARYTTITSAQKCYDRIIYCDTDSMHLEGLDVPESIKDIVADDVLGYWEKEGQFKQGKFIRQKTYMEEYYAKYVRDENGEIKYDDEKPYKTICDKEESDTTIIEIKCAGMPDNIKKHVTFDNFDIGFTMEGKLKPKQVYGGVVLVEETYTMK

SEQ ID NO: 315 - protein, 573 aa, Artificial Sequence
  Synthetic Polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 316 - protein, 592 aa, Artificial Sequence
  Synthetic Polypeptide
MATKKRKAYSCDFEATTSTYSETETRVWAYGWMEIGNTSHFNIGDNLDEFMLWTSKECADLYFHDLRYDGEFIVNWLLHKGYECNESGRPKTFDTVISKGGQWYKIAIHHEGKGTTQIFDSLKKLPFPVKTIAKAFKLPVLKGDIDINLHRDENHVITSEEFTYIKHDIEIVARALDIQINQQGLVKMTNGADSMDHFIKSLDKKKKVAERIYNQYFPKMSIAMDSIFRKAYRGGFTWVNPKFKGQEVGEGMVFDANSAYPSVMYYKPLPWGKPVPFVGKYEEDPDFPLYICHIKTGFVLKEGHIPTIQIKKNPIFQENEYLETSGGAPVDLHVTNVDLELIKEHYELYDTEYVGGWKFRQQTGIFNNFIDYWMKIKTDPKSTPAIVTLAKLQLNSLYGKFASHPDVTGKVPYLKDDGSTAFKKGLPKSKDPVYTPAGAFITAWARHMTITTAQKVYDRILYCDTDSIHILGIDIPEAIKNDIHQKELGKWEFECMFKRAKFVRQKTYVEDMYAKFMKYWEDGELNYYLKECVKEEATARLLNVKCAGMPQAVKKFVTFRTFAVGFTSDTGKLKPKHVKGGQILVDVPFTIK

SEQ ID NO: 317 - protein, 573 aa, Artificial Sequence; identical to SEQ ID NO: 34
  Synthetic Polypeptide

SEQ ID NO: 318 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 319 - protein, 573 aa, Artificial Sequence; identical to SEQ ID NO: 310
  Synthetic Polypeptide

SEQ ID NO: 320 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 321 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 322 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 323 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 324 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWTEVKTTTYGARKQLAKLMLNSLYGKFGTNPDITGKVPYMGEDGIVRLTLGEEELRDPVYVPLASFVTAWGRYTTITTAQRCFDNIIYCDTDSIHLTGTEVPEAIEHLVDPKKLGYWEHESTFKRAKFIRQKTYVEEIDGELNVKCAGMPDRIKELVTFDNFEVGFSSYGKLLPKRTQGGVVLVDTMFTIK

SEQ ID NO: 325 - protein, 573 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKQNAKLMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 326 - protein, 591 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIYMKRVKGYLVQGSPDDYTDGELNVKCAGMPDRIKELVTFDNFEVGFSSYGKLLPKRTQGGVVLVDTMFTIK

SEQ ID NO: 327 - protein, 608 aa, Artificial Sequence; identical to SEQ ID NO: 22
  Synthetic Polypeptide

SEQ ID NO: 328 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 329 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 330 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSKGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 331 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGKLVQGSPDDYTDIKFSVKCAGMTDKIKKEVTFENFKVGFSRKMKPKPVQVPGGVVLVDETFTIK

SEQ ID NO: 332 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWCHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 333 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIRQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 334 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKRLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 335 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDARSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 336 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDDKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 337 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 338 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPDKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 339 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAFRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 340 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 341 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWCHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 342 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWSHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 343 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWTHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 344 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWNHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 345 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWQHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 346 - protein, 575 aa, Artificial Sequence [sequence omitted]

SEQ ID NO: 347 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGKLVQGSPDDYTDIKFSVKCAGMTDKIKKEVTFENFKVGFSRKMKPKPVQVPGGVVLVDETFTIK

SEQ ID NO: 348 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWNHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 349 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWQHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 350 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKFGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 351 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMKSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 352 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPSQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 353 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKDTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 354 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAWKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 355 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQWAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 356 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLFLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 357 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKAFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 358 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTRSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 359 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWDYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKKGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 360 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWEYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKKGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 361 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 362 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 363 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 364 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGKLVQGSPDDYTDIKFSVKCAGMTDKIKKEVTFENFKVGFSRKMKPKPVQVPGGVVLVDETFTIK

SEQ ID NO: 365 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGKLVEGSPDDYTDIKFSVKCAGMTDKIKKEVTFENFKVGFSRKMKPKPVQVPGGVVLVDETFTIK

SEQ ID NO: 366 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKEVDGKLVQGSPDDYTDIKFSVKCAGMTDKIKKEVTFENFKVGFSRKMKPKPVQVPGGVVLVDETFTIK

SEQ ID NO: 367 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDETFTIK

SEQ ID NO: 368 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDETFTIK

SEQ ID NO: 369 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 370 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKHVDGKLVEGSPDDYTKIKFSVKCAGMTDKIKKEVTFENFKVGFSRKMKPKPVQVPGGVVLVDDTFTIK

SEQ ID NO: 371 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKHVHGKLVEGSPDDYTKIKFSVKCAGMTDKIKKEVTFENFKVGFSRKMKPKPVQVPGGVVLVDDTFTIK

SEQ ID NO: 372 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKEVDGKLVEGSPDDYTDIKLSVKCAGMTDKIKKEVTFENFKVGFSRKMKPKPVQVPGGVVLVDDTFTIK

SEQ ID NO: 373 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVDGKLVEGSPDDYTKIKLSVKCAGMTDKIKKEVTFENFKVGFSRKMKPKPVQVPGGVVLVDDTFTIK

SEQ ID NO: 374 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVHGKLVEGSPDDYTKIKLSVKCAGMTDKIKKEVTFENFKVGFSRKMKPKPVQVPGGVVLVDDTFTIK

SEQ ID NO: 375 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKNVNGKLVEGSPDDYTKIKLSVKCAGMTDKIKKEVTFENFKVGFSRKMKPKPVQVPGGVVLVDDTFTIK

SEQ ID NO: 376 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVHGKLVEGSPDDYTKIKLSVKCAGMTDKIKKEVTFENFKVGFSRKMKPKPVQVPGGVVLVDDTFTIK

SEQ ID NO: 377 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKNVNGKLVEGSPDDYTKIKLSVKCAGMTDKIKKEVTFENFKVGFSRKMKPKPVQVPGGVVLVDDTFTIK

SEQ ID NO: 378 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVDGKLVEGSPDDYTKIKLSVKCAGMTDKIKKEVTFENFKVGFSRKMKPKPVQVPGGVVLVDDTFTIK

SEQ ID NO: 379 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVHGKLVEGSPDDYTKIKLSVKCAGMTDKIKKEVTFENFKVGFSRKMKPKPVQVPGGVVLVDDTFTIK

SEQ ID NO: 380 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKHVDGKLVEGSPDDYTKIKFSVKCAGMTDKIKKEVTFENFKVGFSRKMKPKPVQVPGGVVLVDDTFTIK

SEQ ID NO: 381 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVHGKLVNGSPDDYTKIKLSVKCAGMTDKIKKEVTFENFKVGFSRKMKPKPVQVPGGVVLVDDTFTIK

SEQ ID NO: 382 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVDGKLVNGSPDDYTKIKLSVKCAGMTDKIKKEVTFENFKVGFSRKMKPKPVQVPGGVVLVDDTFTIK

SEQ ID NO: 383 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEQYPLYIQRIRFEFELKEGYIPTIQIKKNPFFKGNEYLKNSGVEPVELYLTNVDLELIQEHYELYNVEYIDGFKFRETTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 384 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKKNPFFKGNEYLKNSGVEPVELYLTNVDLELIQEHYELYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 385 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKKNPFFKGNEYLKNSGVEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 386 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCEFELKDGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 387 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCDFELKDGYIPTIQIKRSRFYKGNEYLKSSGGDLVELWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 388 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCDFELKDGYIPTIQIKRSRFYKGNEYLKSSGGDLVELWISQVDIDLMKEHYELYNVEYLSGIKFRATTGIFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 389 - protein, 572 aa, Artificial Sequence
  Synthetic Polypeptide
MSRKMFSCDFETTTRLDDCRVWAYGYMEIGNLDNYKLGNSLDEFMQWVMEINADLYFHDLKFDGAFLVNWLEQHGFRWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 390 - protein, 572 aa, Artificial Sequence
  Synthetic Polypeptide
MSRKMFSCDFETTTRLDDCRVWAYGYMEIGNLDNYKLGNSLDEFMQWVMEINADLYFHDLKFDGAFLVNWLEQHGFRWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCDFELKDGYIPTIQIKRSRFYKGNEYLKSSGGDLVELWISQVDIDLMKEHYELYNVEYLSGIKFRATTGIFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 391 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCDFELKDGYIPTIQIKRSRFYKGNEYLKSSGGELVELYVTNIDLDLIKEHYELYNVEYLSGLKFRATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 392 - protein, 572 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 393 - protein, 582 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 394 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 395 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 396 - protein, 572 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 397 - protein, 587 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 398 - protein, 572 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 399 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 400 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 401 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 402 - protein, 576 aa, Artificial Sequence
  Synthetic Polypeptide
MKHMPRKMYSCDFETTTDVNDCRVWAYGWMEIGKTSNYKIGTDFNEFMEWMIHSSSRLYFHDLKFDGSFIVNWLLHNGYTWTKRPSKEGQFSTLISKMGQWYGITICSGRDGRKKKLTTIHDSLKKLPFPVRKIGKDFKLNVLKGDIDYHKPRPIGYEIDDEEYQYIKNDIQIIAEALEVQTVQGLTGMTNGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 403 - protein, 576 aa, Artificial Sequence
  Synthetic Polypeptide
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 404 - protein, 577 aa, Artificial Sequence
  Synthetic Polypeptide
MKHMPRKMYSCDFETTTDVNDCRVWAYGWMEIGKTSNYKIGTDFNEFMEWMIHSSSRLYFHDLKFDGSFIVNWLLHNGYTWTKRPSKEGQFSTLISKMGQWYGITICSGRDGRKKKLTTIHDSLKKLPFPVRKIGKDFKLNVLKGDIDYHKPRPIGYEIDDEEYQYIKNDIQIIAEALEVQTVQGLTGMTNGSDSLKGFKDIITTKKFKKVFPTLSLGLDKEVRKAYRGGFTWLNDRFKGKEIGEGMVFDANSHYPAQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 405 - protein, 575 aa, Artificial Sequence; identical to SEQ ID NO: 339
  Synthetic Polypeptide

SEQ ID NO: 406 - protein, 582 aa, Artificial Sequence
  Synthetic Polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 407 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEVPEAIEHLVDSKKLGYWEHESTFQRAKFIRQKTYIQDIYMKRVKGYLVQGSPDDYTDIKFSVKCAGMTDKIKKEVTFENFKVGFSRKMKPKPVQVPGGVVLVDETFTIK

SEQ ID NO: 408 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEVPEAIEHLVDPKKLGYWEHESTFQRAKFIRQKTYIQDIYMKRVKGYLVQGSPDDYTDIKFSVKCAGMTDKIKKEVTFENFKVGFSRKMKPKPVQVPGGVVLVDETFTIK

SEQ ID NO: 409 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKKVRGYLVQCSPDEATTTKFSVKCAGMTDKIKKEVTFENFKVGFSRKMKPKPVQVPGGVVLVDETFTIK

SEQ ID NO: 410 - protein, 572 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEVPEAIEHLVDPKKLGYWEHESTFQRAKFIRQKTYIQDIYVKKVRGYLVQCSPDEATTTKFSVKCAGMTDKIKKEVTFENFKVGFSRKMKPKPVQVPGGVVLVDETFTIK

SEQ ID NO: 411 - protein, 572 aa, Artificial Sequence
  Synthetic Polypeptide
MIKKYTGDFETTTDLNDCRVWSWGVCDIDNVDNITFGLEIDSFFEWCEMQGSTDLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 412 - protein, 577 aa, Artificial Sequence
  Synthetic Polypeptide
MIKKYTGDFETTTDLNDCRVWSWGVCDIDNVDNITFGLEIDSFFEWCEMQGSTDIYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 413 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 414 - protein, 596 aa, Artificial Sequence
  Synthetic Polypeptide
MVRQSTIASPARGGVRRSHKKVPSFCADFETTTDEDDCRVWSWGIIQVGKLQNYVDGISLDGFMSHISERASHIYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 415 - protein, 579 aa, Artificial Sequence
  Synthetic Polypeptide
MNEYISDFETQKDPDTGVMSVWAWSIVDVNDLSNIQYGNNIESWLSAIQGLPNGSLIGFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 416 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 417 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMPDRIKELVTFDNFEVGFSSYGKLLPKRTQGGVVLVDTMFTIK

SEQ ID NO: 418 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEELRDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMPDRIKELVTFDNFEVGFSSYGKLLPKRTQGGVVLVDTMFTIK

SEQ ID NO: 419 - protein, 572 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIYSEGAPRTNRPLYIASITFTAKLKPNHIPCIQIKKNLSFNPTQYLEEVKEPTTVVATNIDIELWKKHYDFKIYSWNGTFEFRGSHGFFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 420 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPIGTPVFFEGKYKDDPIYPLYIQFITAQFELKKGKIPTIQIKNDKRFNPREYVTSTGCLMVNLYLTNVDLEMFYECYNIKEIQYIGGYKFIGRSGIFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 421 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 422 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISRMGQWYMIDICLGYKGKRKIHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 423 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLERNGFKWSNEGLPNTYNTIISKMGQWYMIDICIGYKGKRKLHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 424 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLERNGFKWSNEGLPNTYNTIISKMGQWYMIDICIGYKGKRKLHTVIYDSLKKLPFPVEKIAKDFQLTLKKGDIDIHKERPVGYEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 425 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 426 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 427 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 428 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 429 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 430 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 431 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 432 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 433 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 434 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 435 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 436 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 437 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 438 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 439 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 440 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 441 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMPDRIKELVTFDNFEVGFSSYGKLLPKRTQGGVVLVDTMFTIK

SEQ ID NO: 442 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 443 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMPDRIKELVTFDNFEVGFSSYGKLLPKRTQGGVVLVDTMFTIK

SEQ ID NO: 444 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMPDRIKELVTFDNFEVGFSSYGKLLPKRTQGGVVLVDTMFTIK

SEQ ID NO: 445 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 446 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMPDRIKELVTFDNFEVGFSSYGKLLPKRTQGGVVLVDTMFTIK

SEQ ID NO: 447 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHFTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 448 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPCIQVKQSSLFIQTEYLESSVNKLGVDELIELTLTNVDLDLFFEHYEILEIHFTYGYMFRGSCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 449 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQNEYLENSVNKLGVDELIELTLTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 450 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQTEYLESSVNKLGVDELIELTLTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 451 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQTEYLENSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 452 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQTEYLESSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 453 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQTEYLENSVNKLGVDELIELTVTNVDLDLFFEHYEILEIHFTYGYMFRGSCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 454 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQTEYLENSVNKLGVDELIELTVTNVDLDLFFEHYEILEIHFTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 455 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDYPLYIQNIKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 456 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQNEYLENSVNKLGVDELIDLTVTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 457 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 458 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 459 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 460 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 461 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 462 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 463 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTVTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 464 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 465 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTVTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 466 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTVTNVDLDLFFEHYEILEIHFTYGYMFRASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 467 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 468 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTVTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 469 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLERNGFKWSNEGLPNTYNTIISKMGQWYMIDICIGYKGKRKLHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 470 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 471 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 472 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 473 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHFTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 474 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPCIQVKQSSLFIQTEYLESSVNKLGVDELIELTLTNVDLDLFFEHYEILEIHFTYGYMFRGSCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 475 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQNEYLENSVNKLGVDELIELTLTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 476 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQTEYLESSVNKLGVDELIELTLTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 477 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQTEYLENSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 478 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQTEYLESSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 479 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQTEYLENSVNKLGVDELIELTVTNVDLDLFFEHYEILEIHFTYGYMFRGSCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 480 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQTEYLENSVNKLGVDELIELTVTNVDLDLFFEHYEILEIHFTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 481 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICFGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 482 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 483 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKLHTIIYDSLKKLPFPVEKIAKDFKLTLKKGDIDIHKERPIGYKITPDEYAYLKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 484 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICFGYKGKRKLHTIIYDSLKKLPFPVEKIAKDFKLTLKKGDIDIHKERPIGYKITPDEYAYLKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 485 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEKNGFKWSAEGIPNTYNTIISRMGQWYMIDICFGYKGKRKLHTIIYDSLKKLPFPVEKIAKDFKLTLKKGDIDIHKERPIGYKITPDEYAYLKNDIQILAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 486 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLEQHGFKWSNEGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 487 - protein, 578 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 488 - protein, 578 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLLHNGYTWTKRPSKEGQFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 489 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLLHKGYECNESGRPKTFDTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 490 - protein, 578 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLLKHGYRWTKENPGVKEFTTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 491 - protein, 578 aa, Artificial Sequence; identical to SEQ ID NO: 487
  Synthetic Polypeptide

SEQ ID NO: 492 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLEKNGFKWTAEGEPNTYSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 493 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLLKNGFKWTAEGLPRTYSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 494 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLFKNGYKWTAEGLPNTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 495 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLEKNGYKWTAEGLPKTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 496 - protein, 580 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLLRNGYVHTEEDRTNTPKEFTTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 497 - protein, 579 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLFRLGYEFTDEKAPQVKEFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 498 - protein, 580 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLLTDGWKWIPDKNDCANRTFTTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 499 - protein, 579 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLLENGFKHSRERALYSNEFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 500 - protein, 581 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLLGVAKWEYNDKPKARKAKTVETIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 501 - protein, 577 aa, Artificial Sequence
  Synthetic Polypeptide
MSRKMYSADFETTTKLDDCRVWSYGWMEVGNLDNYKIGNDIDEFMQWVMEIQSDLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 502 - protein, 577 aa, Artificial Sequence
  Synthetic Polypeptide
MSRKMYSCDFETTTKLDDCRVWAYGVMEVGNLDNYKIGNDIDEFMQWIMEIQSDLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 503 - protein, 577 aa, Artificial Sequence
  Synthetic Polypeptide
MSRKVFTADFETTTKLDDCRVWAYGWMEVGNLDNYKIGNSIDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 504 - protein, 577 aa, Artificial Sequence
  Synthetic Polypeptide
MSRKVYTADFETTTKLDDCRVWAYGWMEVGNLDNYKIGNSIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 505 - protein, 577 aa, Artificial Sequence
  Synthetic Polypeptide
MSRKMYTADFETTTKLDDCRVWAYGYMEVGNLDNYKIGNDIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 506 - protein, 577 aa, Artificial Sequence
  Synthetic Polypeptide
MSRKMYSADFETTTKLDDCRVWAYGYMEVGNLDNYKIGNSIDEFMQWIMEIQSDLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 507 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 508 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWNHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 509 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWQHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 510 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTRSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 511 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 512 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 513 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 514 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 515 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIQYPLYIQNIKVRFRLKERHIPTIQVKQSSLFIQNEYLESSVNKLGVDELIDLTLTNVDLDLFFEHYDILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 516 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAQDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSHYPAQMYVRPLPYGTPLFYEGEYKENIQYPLYIQNIKVRFRLKERHIPTIQVKQSSLFIQNEYLESSVNKLGVDELIDLTLTNVDLDLFFEHYDILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 517 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 518 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIQYPLYIQNIKVRFRLKERHIPTIQVKQSSLFIQNEYLESSVNKLGVDELIDLTLTNVDLDLFFEHYDILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 519 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAQDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIQYPLYIQNIKVRFRLKERHIPTIQVKQSSLFIQNEYLESSVNKLGVDELIDLTLTNVDLDLFFEHYDILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 520 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 521 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 522 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 523 - protein, 578 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 524 - protein, 578 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 525 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIQHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 526 - protein, 578 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 527 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 528 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIQHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 529 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAQDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIQHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 530 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAQDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 531 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 532 - protein, 578 aa, Artificial Sequence
  Synthetic Polypeptide
MSRKRFSCDFETTTKLDDCRVWAYGYMEVGNLDNYKIGNSIDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 533 - protein, 580 aa, Artificial Sequence
  Synthetic Polypeptide
MHKMSKKMFSCDFETTTKLDDCRVWAYGYMEVGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 534 - protein, 580 aa, Artificial Sequence
  Synthetic Polypeptide
MHKMSRKMFSCDFETTTKLDDCRVWAYGYMEVGNLDNYKIGNSIDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 535 - protein, 577 aa, Artificial Sequence
  Synthetic Polypeptide
MSKKMFSCDFETTTKLDDCRVWAYGYMEVGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 536 - protein, 577 aa, Artificial Sequence
  Synthetic Polypeptide
MSRKMFSCDFETTTKLDDCRVWAYGYMEVGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 537 - protein, 577 aa, Artificial Sequence
  Synthetic Polypeptide
MSRKMFSCDFETTTKLDDCRVWAYGYMELGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 538 - protein, 577 aa, Artificial Sequence
  Synthetic Polypeptide
MSRKMFSCDFETTTKLDDCRVWAYGYMELGNLDNYKIGNTIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 539 - protein, 577 aa, Artificial Sequence
  Synthetic Polypeptide
MSRKMFSCDFETTTKLDDCRVWAYGYMEVGNLDNYKIGNTIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 540 - protein, 577 aa, Artificial Sequence
  Synthetic Polypeptide
MSRKMFSCDFETTTKLDDCRVWAYGYMEIGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 541 - protein, 577 aa, Artificial Sequence
  Synthetic Polypeptide
MSRKMFSCDFETTTKLDDCRVWAYGYMEIGNLDNYKIGNTIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 542 - protein, 577 aa, Artificial Sequence
  Synthetic Polypeptide
MSRKMFSCDFETTTKLDDCRVWAYGYMEVGNLDNYKIGNTLDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 543 - protein, 577 aa, Artificial Sequence
  Synthetic Polypeptide
MSRKMFSCDFETTTKLDDCRVWAYGYMEVGNLDNYKIGNSIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 544 - protein, 577 aa, Artificial Sequence
  Synthetic Polypeptide
MSRKMFSCDFETTTKLDDCRVWAYGYMELGNLDNYKIGNSIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 545 - protein, 580 aa, Artificial Sequence
  Synthetic Polypeptide
MHKMSRKRFSCDFETTTKLDDCRVWAYGYMEVGNLDNYKIGNNIDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 546 - protein, 577 aa, Artificial Sequence
  Synthetic Polypeptide
MSRKRFSCDFETTTKLDDCRVWAYGYMEVGNLDNYKIGNNIDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 547 - protein, 577 aa, Artificial Sequence
  Synthetic Polypeptide
MSRKRFSCDFETTTKLDDCRVWAYGYMEVGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 548 - protein, 577 aa, Artificial Sequence
  Synthetic Polypeptide
MSRKRFSCDFETTTKLDDCRVWAYGYMEVGNLDNYKIGNTIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 549 - protein, 577 aa, Artificial Sequence
  Synthetic Polypeptide
MSRKMFSCDFETTTKLDDCRVWAYGYMEVGNLDNYKIGNNIDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 550 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 551 - protein, 581 aa, Artificial Sequence
  Synthetic Polypeptide
MHKMSRKRFSCDFETTTKLDDCRVWAYGYMEVGNLDNYKIGNNIDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 552 - protein, 581 aa, Artificial Sequence
  Synthetic Polypeptide
MHKMSRKRFSCDFETTTKLDDCRVWAYGYMEVGNLDNYKIGNNIDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 553 - protein, 581 aa, Artificial Sequence
  Synthetic Polypeptide
MHKMSRKRFSCDFETTTKLDDCRVWAYGYMEVGNLDNYKIGNNIDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 554 - protein, 581 aa, Artificial Sequence
  Synthetic Polypeptide
MHKMSRKRFSCDFETTTKLDDCRVWAYGYMEVGNLDNYKIGNNIDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 555 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 556 - protein, 581 aa, Artificial Sequence
  Synthetic Polypeptide
MHKMSKKMFSCDFETTTKLDDCRVWAYGYMEVGNLDNYKIGNNIDEFMQWIMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 557 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 558 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 559 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVKGYLVQGSPDDYTDIKFSVKCAGMTDKIKEEVTFENFKVGFSRKMKPKPVQVPGGVVLVDSVFTIK

SEQ ID NO: 560 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDIVHPKKLGYWEHESTFKRAKYLRQKTYIQDIYMKRVKGYLVQGSPDDYTDTKFSVKCAGMTDKIKEEVTFENFKVGFSRKMKPKPVQVPGGVVLVDSVFTIK

SEQ ID NO: 561 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDIVHPKKLGYWEHESTFKRAKYLRQKTYIQDIYMKRVKGYLVQGSPDDYTDGKFSVKCAGMTDKIKEEVTFENFKVGFSRKMKPKPVQVPGGVVLVDSVFTIK

SEQ ID NO: 562 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDGKFSVKCAGMTDKIKEEVTFENFKVGFSRKMKPKPVQVPGGVVLVDSVFTIK

SEQ ID NO: 563 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 564 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKLHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 565 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKQHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 566 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTVTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 567 - protein, 579 aa, Artificial Sequence
  Synthetic Polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTVTNVDLDLFFEHYEILEIHYTYGYMFRSSCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 568 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 569 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 570 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 571 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 572 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 573 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 574 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 575 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVKGYLVQGSPDDYTDIKFSVKCAGMTDKIKEEVTFENFKVGFSRKMKPKPVQVPGGVVLVDSVFTIK

SEQ ID NO: 576 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDIVHPKKLGYWEHESTFKRAKYLRQKTYIQDIYMKRVKGYLVQGSPDDYTDTKFSVKCAGMTDKIKEEVTFENFKVGFSRKMKPKPVQVPGGVVLVDSVFTIK

SEQ ID NO: 577 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDIVHPKKLGYWEHESTFKRAKYLRQKTYIQDIYMKRVKGYLVQGSPDDYTDGKFSVKCAGMTDKIKEEVTFENFKVGFSRKMKPKPVQVPGGVVLVDSVFTIK

SEQ ID NO: 578 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDGKFSVKCAGMTDKIKEEVTFENFKVGFSRKMKPKPVQVPGGVVLVDSVFTIK

SEQ ID NO: 579 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 580 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKLHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 581 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKQHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 582 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTVTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 583 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTVTNVDLDLFFEHYEILEIHYTYGYMFRSSCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 584 - protein, 578 aa, Artificial Sequence; identical to SEQ ID NO: 573
  Synthetic Polypeptide

SEQ ID NO: 585 - protein, 578 aa, Artificial Sequence; identical to SEQ ID NO: 574
  Synthetic Polypeptide

SEQ ID NO: 586 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 587 - protein, 575 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDVNSMYPAMMKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGFIGFFDEYIDRFMEIKNSPDSSAEQSLQAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 588 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKKNVEYPLYIQQVRCFFELKKDKIPCIQIKGNARFGQNEYLSTSGDEYVDLYVTNVDWELIKKHYDIFEEEFIGGFMFKGFIGFFDDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 589 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 590 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 591 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKPNNDYPLYIQNIKVRFRLKEGYIPTIQVKQSSLFIQNEYLDSSVNKLGVDELIDLTLTNVDLELFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 592 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKEGYIPTIQIKRSRFYKGNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 593 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKEGYIPTIQIKRSRFYKGNEYLKSSGGELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 594 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKEGYIPTIQIKRSRFYKGNEYLKSSGGELIELTLTNVDLELMKEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 595 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRLLPYGEPLFYEGEYKENIDHPLYIQNLKVRFRLKEGYIPTIQIKRSRFYKGNEYLKSSGGELIELTLTNVDLELMKEHYEILEIHYTYGYMFKATTGMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 596 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRLLPYGEPLFYEGEYKENIDHPLYIQNLKVRFRLKERHIPCIQVKQSSLFIQNEYLESSVNKLGVDELIELTLTNVDLDLFFEHYEILEIHYTYGYMFKATTGMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 597 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRLLPYGEPLFYEGEYKENIDHPLYIQNLKVRFRLKEGYIPTIQIKRSRFYKGNEYLKSSGGELIELTLTNVDLDLFFEHYEILEIHYTYGYMFKATTGMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 598 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKRSRLFIQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 599 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKRSRLFKQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 600 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKRSRLYKQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 601 - protein, 573 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKRSRFYKGNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 602 - protein, 573 aa, Artificial Sequence; identical to SEQ ID NO: 599
  Synthetic Polypeptide

SEQ ID NO: 603 - protein, 574 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGLPVPFSGEYEYDETHPLFIQHIKCGFELKDGHIPTIQIKKNFRFADNEYLHSSEGNILDLHVTNVDLALIKEHYTLYEEEYLQGYKFKQVTGLFKNYIDYWSDKKINAEDPAIRQMAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 604 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 605 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 606 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 607 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 608 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 609 - protein, 575 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDVNSMYPAMMKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGFIGFFDEYIDRFMEIKNSPDSSAEQSLQAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 610 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRLFIQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 611 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRLFKQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 612 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRLYKQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 613 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRFYKGNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 614 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRLFKQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 615 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKEGYIPTIQIKRSRFYKGNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 616 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKEGYIPTIQIKRSRFYKGNEYLKSSGGELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 617 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKEGYIPTIQIKRSRFYKGNEYLKSSGGELIELTLTNVDLELMKEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 618 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 619 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 620 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 621 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 622 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKEGYIPTIQIKRSRFYKGNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 623 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKEGYIPTIQIKRSRFYKGNEYLKSSGGELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 624 - protein, 573 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKEGYIPTIQIKRSRFYKGNEYLKSSGGELIELTLTNVDLELMKEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 625 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 626 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 627 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVKGYLVQGSPDDYTDIKFSVKCAGMTDKIKEEVTFENFKVGFSRKMKPKPVQVPGGVVLVDSVFTIK

SEQ ID NO: 628 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDIVHPKKLGYWEHESTFKRAKYLRQKTYIQDIYMKRVKGYLVQGSPDDYTDTKFSVKCAGMTDKIKEEVTFENFKVGFSRKMKPKPVQVPGGVVLVDSVFTIK

SEQ ID NO: 629 - protein, 572 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 630 - protein, 576 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 631 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 632 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDHPLHIQHLRCEFELKEGYIPCIQIKQSLFYKGNEYLKSSGGEIAELWLSNVDLELMKEHYELYNVEYISGLKFRATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 633 - protein, 580 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 634 - protein, 572 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 635 - protein, 576 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 636 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 637 - protein, 572 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 638 - protein, 573 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 639 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 640 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 641 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 642 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 643 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 644 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 645 - protein, 577 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 646 - protein, 575 aa, Artificial Sequence
  Synthetic Polypeptide
MKHMPRKMYSCDFETTTKVEDCRVWAYGYMNIEDHSEYKIGNSLDEFMAWVLKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDHPLHIQHLRCEFELKEGYIPCIQIKQSLFYKGNEYLKSSGGEIAELWLSNVDLELMKEHYELYNVEYISGLKFRATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 647 - protein, 575 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYSRLLPYGEPIVFEGKYVWDEDHPLHIQHLRCEFELKEGYIPCIQIKQSLFYKGNEYLKSSGGEIAELWLSNVDLELMKEHYELYNVEYISGLKFRATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 648 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 649 - protein, 577 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 650 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 651 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQNSLFIQNEYLENSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 652 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 653 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQSSLFIQNEYLENSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 654 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLENSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 655 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 656 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 657 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICVGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 658 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 659 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKQHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYVQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 660 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIEITLTNVDVDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 661 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYVQNLKVRFRLKERHIPCIQVKQSSLFIQNEYLESSVNKLGVDELIEITLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 662 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKQHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDVDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 663 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTVTNVDLDLFFEHYEILEIHYTYGYMFRGSCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 664 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTVTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 665 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRGSCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 666 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTVTNVDLDLFFEHYEILEIHYTYGYMFRGSCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 667 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVDGYLVQGSPDDYTDIKFSVKCAGMTDKIKEEVTFENFKVGFSRKMKPKPVQVPGGVVLVDSVFTIK

SEQ ID NO: 668 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKLSVKCAGMTDKIKEEVTFENFKVGFSRKMKPKPVQVPGGVVLVDSVFTIK

SEQ ID NO: 669 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLENSVNKLGVDELIEITLTNVDVDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 670 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 671 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 672 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 673 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 674 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 675 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 676 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 677 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 678 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 679 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 680 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 681 - protein, 578 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 682 - protein, 577 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 683 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 684 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 685 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 686 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 687 - protein, 578 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 688 - protein, 578 aa, Artificial Sequence
  Synthetic Polypeptide
MSRKRFSCDFETTTKLDDCRVWAYGYMEIGNLDNYKIGNSLDEFMQWAMEIQADLYFHDLKFDGAFIINWLFRNGFKWCKDAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 689 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 690 - protein, 577 aa, Artificial Sequence
  Synthetic Polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 691 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 692 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 693 - protein, 581 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 694 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 695 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 696 - protein, 577 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 697 - protein, 577 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 698 - protein, 581 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 699 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 700 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 701 - protein, 581 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 702 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 703 - protein, 581 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 704 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 705 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 706 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 707 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 708 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 709 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 710 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 711 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 712 - protein, 581 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 713 - protein, 581 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 714 - protein, 581 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 715 - protein, 581 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 716 - protein, 577 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 717 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 718 - protein, 580 aa, Artificial Sequence
  Synthetic Polypeptide
MKHMPRKRYSCDFETTTKLDDCRVWAYGYMEIGNLDNYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 719 - protein, 580 aa, Artificial Sequence
  Synthetic Polypeptide
MKHMSRKRFSCDFETTTKLDDCRVWAYGYMEIGNLDNYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 720 - protein, 581 aa, Artificial Sequence
  Synthetic Polypeptide
MKHMPRKRYSCDFETTTKLDDCRVWAYGYMEIGNLDNYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 721 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 722 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 723 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLAVFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 724 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 725 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLAVFVTAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 726 - protein, 580 aa, Artificial Sequence
  Synthetic Polypeptide
MKHMSRKRYSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 727 - protein, 577 aa, Artificial Sequence
  Synthetic Polypeptide
MPRKRYSCDFETTTKVEDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 728 - protein, 577 aa, Artificial Sequence
  Synthetic Polypeptide
MSRKRFSCDFETTTKLDDCRVWAYGYMNIEDHSEYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 729 - protein, 577 aa, Artificial Sequence
  Synthetic Polypeptide
MSRKRFSCDFETTTKLDDCRVWAYGYMEIGNLDNYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 730 - protein, 577 aa, Artificial Sequence
  Synthetic Polypeptide
MSRKRFSCDFETTTKLDDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 731 - protein, 577 aa, Artificial Sequence
  Synthetic Polypeptide
MPRKRYSCDFETTTKVEDCRVWAYGYMEIGNLDNYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 732 - protein, 577 aa, Artificial Sequence
  Synthetic Polypeptide
MPRKRYSCDFETTTKVEDCRVWAYGYMNIEDHSEYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 733 - protein, 580 aa, Artificial Sequence
  Synthetic Polypeptide
MKHMPRKRYSCDFETTTKLDDCRVWAYGYMEIGNLSEYKIGNSLDEFMQWAMKIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 734 - protein, 580 aa, Artificial Sequence
  Synthetic Polypeptide
MKHMPRKRYSCDFETTTKLDDCRVWAYGYMEIGNHSEYKIGNSLDEFMQWAMKIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 735 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 736 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFGTNPDITGKVPYMGEDGIVRLTLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMPDRIKELVTFDNFEVGFSSYGKLLPKRTQGGVVLVDTMFTIK

SEQ ID NO: 737 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFGTNPDITGKVPYMGEDGIVRLTLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 738 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFGTNPDITGKVPYMGEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMPDRIKELVTFDNFEVGFSSYGKLLPKRTQGGVVLVDTMFTIK

SEQ ID NO: 739 - protein, 577 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMPDRIKELVTFDNFEVGFSSYGKLLPKRTQGGVVLVDTMFTIK

SEQ ID NO: 740 - protein, 580 aa, Artificial Sequence
  Synthetic Polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMPDRIKELVTFDNFEVGFSSYGKLLPKRTQGGVVLVDTMFTIK

SEQ ID NO: 741 - protein, 577 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 742 - protein, 577 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMPDRIKELVTFDNFEVGFSSYGKLLPKRTQGGVVLVDTMFTIK

SEQ ID NO: 743 - protein, 573 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKEGYIPTIQIKQSLFYKGNEYLKSSGGELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 744 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 745 - protein, 573 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKRSRLFIQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 746 - protein, 573 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKEGYIPTIQIKRSRFYKGNEYLKSSGGELIELTLTNVDLELMKEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 747 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 748 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 749 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 750 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDVNSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 751 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDVNSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 752 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 753 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 754 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 755 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 756 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 757 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 758 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGSLGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 759 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGILGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 760 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGALGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 761 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKEDGALGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 762 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 763 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKEDGIVGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 764 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGIVGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 765 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 766 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGAVGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 767 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 768 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPKQVPGGVVLVDSVFTIK

SEQ ID NO: 769 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQVPGGVVLVDSVFTIK

SEQ ID NO: 770 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 771 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFENFKVGFSRKMKPKPVQTPGGVVLVDSVFTIK

SEQ ID NO: 772 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDTIKEEVTFDNFKVGFSRKMKPKPKQVPGGVVLVDSVFTIK

SEQ ID NO: 773 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDTIKEEVTFDNFKVGFSRKMKPKPVQVPGGVVLVDSVFTIK

SEQ ID NO: 774 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDTIKEEVTFDNFKVGFSRKMKPKPVQTPGGVVLVDSVFTIK

SEQ ID NO: 775 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPIGYKITPEEYAYIKNDIQIIAEALLIQFKQGLDRMTAGSDSLKDFKDILTTKKFKKVFPTLSLGLDKEIRKAYRGGFTWVNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 776 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 777 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 778 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 779 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKDDGALGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 780 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 781 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPKQVPGGVVLVDSVFTIK

SEQ ID NO: 782 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 783 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 784 - protein, 578 aa, Artificial Sequence
  Synthetic Polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 785 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPIGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 786 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGSLGFRVGDEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 787 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGSLGFRVGDEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDTIKEEVTFDNFAVGFSRKMKPKPVQVPGGVVLVDSVFTIK

SEQ ID NO: 788 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLAVFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 789 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKKLTTIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 790 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKQRTIFYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 791 - protein, 578 aa, Artificial Sequence; identical to SEQ ID NO: 790
  Synthetic Polypeptide

SEQ ID NO: 792 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKNHVVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 793 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKNHVVFYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 794 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKGTTQIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 795 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKFRVEIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 796 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKFRVEFYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 797 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDKYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 798 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNPKYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 799 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNPKFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 800 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNPRYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 801 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLDPKYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 802 - protein, 578 aa, Artificial Sequence
  Synthetic Polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLDPRYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 803 - protein, 53 aa, Unknown
  Phi29
DLYFHNLKFDGAFIINWLERNGFKWSADGLPNTYNTIISRMGQWYMIDICLGY

SEQ ID NO: 804 - protein, 53 aa, Unknown
  M2Y
DLYFHNLKFDGAFIVNWLEQHGFKWSNEGLPNTYNTIISKMGQWYMIDICLGY

SEQ ID NO: 805 - protein, 54 aa, Lucilia cuprina
RLYFHNLKFDGSFIVNWLLHNGYTWTKRPSKEGQFSTLISKMGQWYGITICSGR

SEQ ID NO: 806 - protein, 54 aa, Enterococcus faecium
DIYFHNEKFDGEFMLSWLFKNGFKWCKEAKEERTFSTLISNMGQWYALEICWNV

SEQ ID NO: 807 - protein, 56 aa, Bacteriophage GA-1
DIYFHNLKFDGSFILPWWLRNGYVHTEEDRTNTPKEFTTTISGMGQWYAVDVCINT

SEQ ID NO: 808 - protein, 53 aa, Unknown
  Bacillus VMY22
DLYFHNLRYDGEFIVNWLLHKGYECNESGRPKTFDTVISKGGQWYKIAIHHEG

SEQ ID NO: 809 - protein, 54 aa, Unknown
  Actinomuces AV-1
HIYFHNLAFDGTFILDWLLKHGYRWTKENPGVKEFTSLISRMGKYYSITVVFET

SEQ ID NO: 810 - protein, 55 aa, Unknown
  Potato cyst nematode
ITFFHNLKFDGAFILDRLFRLGYEFTDEKAPQVKEFSTLISKMGQFYSIKVRWEN

SEQ ID NO: 811 - protein, 56 aa, Unknown
  Iberlian Lynx Gut
RVYFHNLKFDGKFILHKILTDGWKWIPDKNDCANRTFTTLISDMSQFYSIKLWFDE

SEQ ID NO: 812 - protein, 55 aa, Unknown
  Candidatus
EVFFHNLKYDGDFIVKFLLENGFKHSRERALYSNEFSTLISDTGTWYEIKICFHA

SEQ ID NO: 813 - protein, 57 aa, Unknown
  Eggerthella sp.
LIGFHNLKFDGSYILSYLLGVAKWEYNDKPKARKAKTVECLISSIGVHYNYRINFTK

SEQ ID NO: 814 - protein, 12 aa, Unknown
  Phi29
NGFKWSADGLPN

SEQ ID NO: 815 - protein, 12 aa, Unknown
  M2Y
HGFKWSNEGLPN

SEQ ID NO: 816 - protein, 13 aa, Lucilia cuprina
NGYTWTKRPSKEG

SEQ ID NO: 817 - protein, 13 aa, Enterococcus faecium
NGFKWCKEAKEER

SEQ ID NO: 818 - protein, 15 aa, Bacteriophage GA-1
NGYVHTEEDRTNTPK

SEQ ID NO: 819 - protein, 12 aa, Unknown
  Bacillus VMY22
KGYECNESGRPK

SEQ ID NO: 820 - protein, 13 aa, Unknown
  Actinomuces AV-1
HGYRWTKENPGVK

SEQ ID NO: 821 - protein, 14 aa, Unknown
  Potato cyst nematode
LGYEFTDEKAPQVK

SEQ ID NO: 822 - protein, 15 aa, Unknown
  Iberlian Lynx Gut
DGWKWIPDKNDCANR

SEQ ID NO: 823 - protein, 14 aa, Unknown
  Candidatus
NGFKHSRERALYSN

SEQ ID NO: 824 - protein, 16 aa, Unknown
  Eggerthella sp.
VAKWEYNDKPKARKAK

SEQ ID NO: 825 - DNA, 215 bp, Artificial Sequence
  Synthetic Polynucleotide
ttagaaaatcttgaaccatagcggatagcttagatttaagagctgagaaggtcaatagtgactttagtaaaatataggtcgatagactacctttgtacctccggttaaagtttggttattaactttgtaaatgatcaaatcaatcccgaaacaagcacgcaaaaaaacttatcaaaatatattttagtaatcattttcctaatgtaaggttgaaa

SEQ ID NO: 826 - DNA, 237 bp, Artificial Sequence
  Synthetic Polynucleotide
ttagaatccttgaaaacatagcgatagcttagattaagacgctgagaagagtcaatagtgaatttatcaaaatcataggtctgagagactacctttttaacctccggcttaggttgggttatataactatatgtaaatgctgatgcaaatccaatcgcaagacaaagaacgcgagaaaactttttcaaatatattttagttaatttcatcttctgacctaaatttaatggtttgaaa

SEQ ID NO: 827 - protein, 61 aa, Unknown
  Phi29
WAHESTFKRAKYLRQKTYIQDIYMKEVDGKLVEGSPDDYTDIKFSVKCAGMTDKIKKEVTF

SEQ ID NO: 828 - protein, 572 aa, Bacteriophage B103; identical to SEQ ID NO: 23

SEQ ID NO: 829 - protein, 572 aa, Bacteriophage phi-29; identical to SEQ ID NO: 24

SEQ ID NO: 830 - protein, 550 aa, Lucilia cuprina
LNNTLNDYFNETTTDVNDCRVWAYGWVEIGKTSNYKIGTDFNEFMEWMIHSSSRLYFHNLKFDGSFIVNWLLHNGYTWTKRPSKEGQFSTLISKMGQWYGITICSGRDYHKPRPIGYEIDDEEYQYIKNDIQIIAEALEVQTVQGLTGMTNGKDALDEFVNMSGKLYEKLFPVFSLELNEEIRKAYRGGFTWLNPVYGTKKYVKDGIVFDVNSLYPSQMYDRDLPCGVPIPFEGEYVYDKSHPLYIQKLTFEFEFKENYIPTIQLKNSRFGFKGNEYLSSSNGERITISVSSVDWELIREHYHVYDVEFEKGWKFRSTKQAFRQYIDKWMLVKNMSAGAKKAIAKLMLNSLYGKFATNPDITGKRPYLEREDGSNGFELMEEEFRDPVYTPVGIFITSWARYTTITSAQKCYDRIIYCDTDSMHLEGLDVPESIKDIVADDVLGYWKKEGQFKQGKFIRQKTYMEEYYAKYVRDENGEIKYDDEKPIKTICDKEESDTTIIEIKCAGMPDNIKKHVTFDNFDIGFTMEGKLKPKQVYGGVVLVEETYTMK

SEQ ID NO: 831 - protein, 608 aa, Unknown; identical to SEQ ID NO: 25
  Bacillus phage BeachBum

SEQ ID NO: 832 - protein, 579 aa, Unknown; identical to SEQ ID NO: 26
  Bacillus phage Karezi

SEQ ID NO: 833 - protein, 553 aa, Unknown; identical to SEQ ID NO: 27
  Firmicutes bacterium

SEQ ID NO: 834 - protein, 570 aa, Unknown; identical to SEQ ID NO: 28
  Clostridium beijerinckii

SEQ ID NO: 835 - protein, 593 aa, Unknown; identical to SEQ ID NO: 29
  Succinivibrio sp.

SEQ ID NO: 836 - protein, 559 aa, Unknown; identical to SEQ ID NO: 30
  Firmicutes bacterium

SEQ ID NO: 837 - protein, 598 aa, Unknown; identical to SEQ ID NO: 31
  Arthrobacter phage Anjali

SEQ ID NO: 838 - protein, 590 aa, Unknown; identical to SEQ ID NO: 32
  Arthrobacter phage Mendel

SEQ ID NO: 839 - protein, 564 aa, Unknown; identical to SEQ ID NO: 33
  Podoviridae sp. Ctbd591

SEQ ID NO: 840 - protein, 4 aa, Artificial Sequence
  Synthetic Polypeptide
EIKG

SEQ ID NO: 841 - protein, 23 aa, Artificial Sequence
  Synthetic Polypeptide
DIYAKRVRGYLIECSPDEATTTK

SEQ ID NO: 842 - protein, 23 aa, Artificial Sequence
  Synthetic Polypeptide
DIYMKRVRGYLVQGSPDDYTDIK

SEQ ID NO: 843 - protein, 27 aa, Artificial Sequence
  Synthetic Polypeptide
GGGSGGGSGGGSGLNDFFEAQKIEWHE

SEQ ID NO: 844 - protein, 55 aa, Artificial Sequence
  Synthetic Polypeptide
GGGGSGGGSGGGSGLNDFFEAQKIEWHEGGGSGGGSGGGSGLNDFFEAQKIEWHE

SEQ ID NO: 845 - protein, 43 aa, Enterococcus faecium
WKHESTFQRAKFIRQKTYVEEIDGELNVKCAGMPDRIKELVTF

What is claimed is:

1. A modified recombinant DNA polymerase based on SEQ ID NO: 2, comprising a first segment and a second segment, wherein:
   the first segment consists of an amino acid sequence corresponding to a first reference segment, said first reference segment consisting of amino acids 197-271 of SEQ ID NO: 2, wherein the amino acid sequence of the first segment is at least 80%, 80-90%, 90-95%, or at least 95% identical to the amino acid sequence of the first reference segment, and wherein the first segment has a higher isoelectric point than the first reference segment; and
   the second segment consists of an amino acid sequence corresponding to a second reference segment, said second reference segment consisting of amino acids 443-528 of SEQ ID NO: 2, wherein the amino acid sequence of the second segment is at least 80%, 80-90%, 90-95%, or at least 95% identical to the amino acid sequence of the second reference segment, and wherein the second segment has a higher isoelectric point than the second reference segment.

2. The modified recombinant DNA polymerase of claim 1, wherein the amino acid sequence of the modified recombi- 3. The modified recombinant DNA polymerase of claim 2, wherein the amino acid sequence of the modified recombinant DNA polymerase comprises a modification at one or more positions corresponding to E139, E142, N145, I148, D167, D171, D189, N467, E482, D492, K495, D521, and E523, wherein optionally, the modification is an amino acid substitution selected from the group consisting of: E139K, E139Q, E139R, E139H, E142K, E142H, E142R, E142Q, N145K, N145H, N145R, I148K, I148H, I148R, D167P, D167K, D167H, D167R, D171K, D171H, D171R, D189K, D189H, D189R, N467R, N467K, N467H, N467S, N467T, E482K, E482H, E482R, D492H, D492K, D492R, K495R, D521K, D521H, D521R, E523K, E523Y, E523H, E523R, E523F, and E523W.

4. The modified recombinant DNA polymerase of claim 1, wherein the amino acid sequence of the modified recombinant DNA polymerase comprises a modification at one or more positions corresponding to P273, P275, R308, V315, Q317, S319, L320, I322, Q323, D337, E338, D341, T345, F352, F353, T364, D374, I384, E385, N388, E391, A396, N397, G400, D414, D425, R429, E436, L437, D533, R534, E537, G547, E545, L555, P556, R558, T559, V564, T568, M569, and T571 of SEQ ID NO: 2, wherein optionally, the modification is an amino acid substitution selected from the group consisting of: P273S, P273R, P275S, E283K, V315L, S319R, R308G, Q317R, S319R, L320M, L320T, I322K, Q323G, Q323V, Q323R, D337G, E338K, D341T, T345I, F352I, F353C, T364I, D374G, D374Q, D374H, I384T, I384F, I384S, E385Y, E385K, E385R, E385N, E385Q, E385L, E385A, N388T, E391Y, E391W, E391F, E391H, E391M, E391K, E391R, A396Q, N397L, G400L, D414V, D425N, R429G, E436R, E436G, L437Y, L437E, D533A, D533Q, D533T, D533R, D533S, R534K, E537K, E537H, E537R, E545K, E545H, E545R, G547S, L555K, L555R, P556A, R558H, T559V, V564L, T568D, T568S, M569K, M569T, M569V, and T571S.

5. The modified recombinant DNA polymerase of claim 4, wherein a modification is an amino acid substitution selected from the group consisting of D374G, D374Q, D374H, E385Y, E385K, E385R, E385N, E385Q, E385L, E385A, E391Y, E391W, E391K, E391F, D533A, D533Q, D533T, D533R, D533S, E537K, E537H, E537R, E545K, E545H, and E545R.

6. The modified recombinant DNA polymerase of claim 1, wherein the amino acid sequence of the modified recombinant DNA polymerase comprises a modification at one or more positions corresponding to E142, I148, D189, V261, L264, R308, E391, E482, D492, K500, D521, E523, and E537 of SEQ ID NO: 2, wherein optionally, the modification at position E142 is E142K; the modification at position I148 is I148K; the modification at position D189 is D189K; the modification at position V261 is V261A; the modification at position L264 is L264H; the modification at position R308 is R308G; the modification at position E391 is E391Y; the modification at position E482 is E482K; the modification at position D492 is D492H; the modification at position K500 is K500E; the modification at position D521 is D521K; the modification at position E523 is E523K; and the modification at position E537 is E537K.

7. The modified recombinant DNA polymerase of claim 6, wherein the modified recombinant enzyme comprises the amino acid sequence of SEQ ID NO: 88.

8. The modified recombinant DNA polymerase of claim 6, wherein the amino acid sequence of the modified recombinant DNA polymerase further comprises a modification at position E60, optionally, wherein the modification at E60 is E60L.

9. The modified recombinant DNA polymerase of claim 8, wherein the modified recombinant DNA polymerase comprises the amino acid sequence of SEQ ID NO: 157.

10. The modified recombinant DNA polymerase of claim 9, wherein the modified recombinant DNA polymerase further comprises a bis-biotin tag.

11. The modified recombinant DNA polymerase of claim 10, wherein the modified recombinant DNA polymerase comprises the amino acid sequence of SEQ ID NO: 180.

12. The modified recombinant DNA polymerase of claim 1, further comprising a purification tag, and optionally, further comprising a coupling group.

13. The modified recombinant DNA polymerase of claim 1, wherein the modified recombinant DNA polymerase is immobilized on a surface, optionally, wherein the surface comprises a nanoaperture.

14. An isolated nucleic acid molecule that encodes the modified recombinant DNA polymerase of claim 1.

15. A composition comprising the modified recombinant DNA polymerase of claim 1.

16. A method of sequencing a nucleic acid, the method comprising contacting the modified recombinant DNA polymerase of claim 1 with a sequencing reaction mixture.

17. The modified recombinant DNA polymerase of claim 1, comprising a third segment comprising consisting of an amino acid sequence corresponding to a reference segment, said reference segment consisting of amino acids 1-196 of SEQ ID NO: 2, wherein the amino acid sequence of the third segment is at least 80%, 80-90%, 90-95%, or at least 95% identical to the amino acid sequence of the reference segment; and wherein the third segment has a higher isoelectric point than the reference segment.

* * * * *

UNITED STATES PATENT AND TRADEMARK OFFICE
CERTIFICATE OF CORRECTION

| | |
|---|---|
| PATENT NO. | : 11,959,105 B2 |
| APPLICATION NO. | : 16/914195 |
| DATED | : April 16, 2024 |
| INVENTOR(S) | : Brian Reed et al. |

Page 1 of 1

It is certified that error appears in the above-identified patent and that said Letters Patent is hereby corrected as shown below:

In the Claims

Column 344 Line 29 In Claim 17:
reading comprising a third segment comprising consisting of an amino acid sequence
Should read:
--comprising a third segment consisting of an amino acid sequence--.

Signed and Sealed this
Tenth Day of December, 2024

Katherine Kelly Vidal
*Director of the United States Patent and Trademark Office*